United States Patent 9,567,581 (SELECTIVE REACTIVATION OF GENES ON THE INACTIVE X CHROMOSOME) - sequence listing, part 10

SEQ ID NO: 1005 - DNA, 61222 bp, mus musculus
tgcttcctcccctctttccctccccgcctcccaggcgcgcacccctcccctcgcgcccctcccgcgccctacatccaccgcccggcggagggggctcagtccgcagccgccgccgccaccgccgcgcctcggcctcggtgcaggcagcggccgccgccgccgagacagctgcgcgggcgagcatccccacgcagtaagcccgctttctttccgcttgtgcgcgcgtgtgtgcctcccgcccgccggcgtcctgggtcccgggggagcggctgcccttctgccccgccgccgccgccgctcggggctggtccctgcggtcccggctgcctggccttccagggctgggtactgcggcttcggcggcctcgctgaggccgggggccaggggccgtcccgggctgcggggtgcgggacgagggactgcgagtgcgaggtcccccctggtgcgtgcctcggccttccctgggtttttggctcgatggggactaagaggcagtggggtggaggtgggggggatcgggagtgaaatgggggctctccatgttttcctgtgcgggggatggtggggagtgaggagggagtgaagggggggccctggttttgtcaccaaggatggcgggcagtggggggtggggcgaggtggggacacctcttggttctttcagccaggatagctagcaggggctgtggggagcgggtgaggatgaagcggtgggtcgactcccttggttttcccatcaaggatggcggggatcgtggaggggggagatgggagacctgccttgcttcgctcaacgaggatggcgggggtggcgacgaggagtagacgtgagggggcccgcctcggttttcttgactgggatgcttgtggggtggttggaggatgggggtggggtgcagaataaggagggagggggagggcccgctgtggttcttctgtccaagggggatggcgcgggtttggcgaatgggggtggggagggggtatttcagctccagcgtggaatctagagaagcacgaggaaggttctatcacgggggttgagccttagaaggtgggttttcaaaactgcagggcgtgacctctcccgcctcgaaaaacgtgaaatccttacaaggtgccgtctgttctaggctctgggacagaggtttctgctttcgaagtttctcttcctttcctctctgctcttagcgtccaggactaggtaaaggttaaaaaatcatcaaggctaagcgactgttgtgtcgttcgtgttgagcgctgtattattttctgcatttgggaatgtgcgagtttctcaggtttgttttgattgccttttacaataaaaaccccatactagggagatcccttaggaaaagaaaaggacaaggcttattaatgggatgccaggtttggattttgaatttcctgaagggcaggagatacatccttgtagcatttcgcttggttttgagaagagtagaagtagtagaataagcgtatgtatttgctggaagtccccttgtattcatttaaattatcccttcgggattatccgagccccctttgatttgggtttggaatagatccagttttcctaattggagccatcatcttgtaattgcttgtaattcttctctgggttatcaagtctatggcaagcttatagaacagcaggaataattttttccgtcatcttaagacagttttaatgtaaacgttacggtgttccttgcaaatgtgaacatttgcagaatagcacaagtttaaattatgggcccccctggaattttgtaaagcctttcctgcctcagctcatctccaagaaccgggccctcccgatccttacactgaagaagcaagagcttctgggatggtagctttgcctttacaaactcatgttcatgtttgcttaagaagaatacgtattaagcaggcatttgccttttatgtggtgagactatagtgttttcccatttttggttacataaggttccgatcaagtctttaccttcagtctttaaaaatgcttatttaacatttttaagggcaaatataatctttatgcaacaggaaattggtcagataggccatgatttgtgcaaaccacctcacgataagtacatagtctaagactatcatatagattctgtaaccatatatggtttttgaaattctaggctaccattcccatatttaattttcagaaaaggaaaatatttttttcagccaagtctagatttttgagtgaaactaagaaaaattgtgtaagatttaaattgataaaattcctcctgtataataccagtgcattggaggtaatttaatatatattaaatgaatcgaccgctaaaacaaaataattattttttttcctggaagtgttaaactggaaatgtttaaggggaaatagatttttagtcacaaagaccgacaaaaatgcatttatttacactattgtattataatgttagtatggtattcattctgtgcccccaaatagcaattgaaaaaatagcatatttttataataaaatttaagcataatgtttttttctctgaggagtagaatgcagaaagtggtaaaaaatcttttacagagagaagcatgttgataggaagtgggctttaagtttctctctggacagaaggtgtaaatggcgtatcttttacctggctttttgagaatctgttgccctctaggacatgaaagacatttcaggaattaacagaagtcggatcaaattctcttgctagatgttcttaaagattttgctgatacgcatttgaaaatttgtaaatcacgttttcatgtaagaaattaaccctcacctctaaagtttgagcattaaaaaagtttgttgaaggcatggaaggtaatctcctgtgactgaaccctgttttcccactctccacctcctagttcccttcttccccatgcctctcctttctcccccgtccggtgccagcaacattggcttttataaccttatgggagttgaaccaaatattcctgcttgctcgaacttgaggccttatctttttggctgctttccccagcttttgcctactgaacttttttttgttaattgaactatctagttgtttggatttggggtaaaagggagtagactgtaattgttttttcttaaaagatcttttcttttagctcctgtgggacaagagcagagaaaggttcttttttggtcagtggtgtacttaattaagcagaatatatgacttttcgtttattcaacaaacatttgccgagttacctcctctgttggaggctccatgctaggtgtggagttatttggttgataagaaatggcttccacctttctggtgaagttatgaaaatgaaaaatagacagtgaatctgttgtgagtaatcaagaattgtctggagttttttggacagacaaaaaagatttcttgatgtttacattcagctttgtattactgtatagagtagggagaagtggatggccagcatcccttcctgcgacttaatgcatctctgatggcaaattgggcctccccaaaatatttttctggggtcaactttgaattatggatagtaatggatgatggagcccagaagagtggatagtcctaaatagtagctcgaataaacctttgaccttctacagggttgcttcctgagtgcctggagaaatcccctctttgtggatagtgccacactggtggttttcagccagggcgcttttgccccccggggtcactcaacaatttttgctagatgcactccactggcatccagttggtagagacagggatgctgcttaaatatccaacagcgcatagggcagtgcctggcggcaaacaaaattatccagcctgaaatgtcgatatgccgaggttgatgtaatttcctctacataatgtagcagaacataattccaggagagtagagaacaataacagcgtcttgaggtgactgagtagttggcggagctcactttattcgtctcaaaaatgactagtttcagccaggtgctgtggttcacgcctgtaatcccagtactttgggaggctgaggcaagcggatcacttgagcccaggagttcgagaccagtctggccaacatggcaaaatcctgtctctactaaaaatacaaagaattagccgggtgtggtggtgtgcgcctgtagtcccagctacttgggaggctgaggcacgagaatcgcttggacccaggaggcggaggttgctgtgagctgagattgcaccactgcactccagcctgggcgacagagtgagaccctgtctcaaaaacataaaataaataaataaaagtgactagttcctgcataccaacctgaagaattaaagaaaataacagctaccatttatggcacttactctgtgccagaggacttgtatacattatatattctcttcattttataaatgaggaaccacactcagagaggtagaagatcttgcctggagcctcacagctggtcaaggttagaagtagaaatcaagattaagattattactccttttaagttcatggttttaagcacaactatgcattatctcccttgcggcatgcatcattcaaaatcttatgtaacaaaatgaaaattactatatgtcctatataccattgggcttgcctgagagtaattaaaaccatgaatgctaaatgtgatcatacttggagtaagtgacaaggagtaggggaaaagggaaccaacattaattgaacacctactaaaatttcaggaagcacgcaaattaaatatatactcattgtctaatttgattctcagagcaactctgcagttatgatgcacattttacagatgagagtgggagatatttgttaagtaacttgtctaagattgcacaactaataagcagcaaggttgggatttgagatgatgtcccacaaccaagccactctttgctgcttactctaaaggtaggaagtaagttgagcctcttggagaaaggaaggtaactggctctgggtaaaaagtaacttcaggcagagcgcagtggcttacgcctgtaatcccagcactttgggaggccaagccgggcagatcacctgaggtcaggagttcaagaccagcctggccaacatggtgaaaccccgtcatggctaaaacacaaaaattagccaggcgtggtagtgggtgcctgtaatcccagctactcgggaggctgaggcaggaagaattgcttgaatccaggagtcggaggttgcagtgagccgagatagcgccactgtattccagcctgggcgacagagctagactccatctcaaaaaaaaaaaaaaaaaaaaaagtaatttgagaggtaacacgtagtagacgttggattatattcaggtagagaatggagagatgaattgctataccttcctcatctgataagaatcgaattctacctggaatttgttctagagatctactcaaattgaaacagtgattgtcattttgtcaaacttcattttctatctcacctgaattttccaagctgtgctttgataaccatgaacctggaagttatggaaatctgtgcttaacctttcggtagctcaccttccacctttcttagggctgtcctgtagaacttaggagtgacaacatttggtttttgtcttctttttacacaatttaaacatttgtgcttgctatggaaattgtttttataatacgcggcatcaaattcattcttgtgtttttcatatggggttgttttgttttgacaactaaatatttactttaagttttaacgtgttttgtttcggagcacaaaaagaggaaacatttaaaaaacagcccaatcacaatcattttgtctgaaaagcatttttttgcgggaggtgggggggggcaggaaaaggaccacatgtttaatttcatttgcttcaattggaaaggaattttaaccacgattctcaagggccaggatgctggaaaaaaatgttatttagataaaatgcctgttttgatatccacatagaactgtgagccatagattctgattataataataatgtcctgattctactacagcaatcagccacttgagtaatcaaccactgtgtatagacagacatgcatggtggtaccatctgatttgtcccatcacccattgattcattctagagtagacttgagagatctgatagaacttgcaagaatgaatgatccttttgaaaatcaaatttttcaataagaatggtacattttattgtaggaaaatgcagaaaatatagaaaagcttcaagaagaaaaccaaaatcagtcataatccaccaccccaaaattaatgacaatattttgtatgtcctttaaaaatggagtactttctaaaaatggtggattcaagcccattgcaaaacctccaacttatatagtgtgttatttttttttaaatgactagattttctgaacgactgctacatctctagatggaagtcatggtcataacccatgaaaagggaaagctgacaggtagttggagaactatgctatagcctcttcctggcagctatgtaaagaagcttaagggtagctccttcaaatttctcctcttccagcttgaatgatcaagtttcaatgctaaaagaggctgttagtacccaccccccattattttacagatgaggaaactgaggctcaaaggggtcaagcacctaatgtgctaacgtcagagttccagcttgaatttttagattgtcttcataggtaggtaaattttttatttcctaaagattcttcacagtcaaaaactttttcatggcctgaccctcaaaagaacaagctattgtggtgggagtatactataaaggatactaaaaggccaagtataataacttgctaatttcagaatatgttccgaacagctgtgggcagtacaggaatttttcatgttatttgctttattgtaattgaacatttagtgatggggaacctcttggatgggtctagctctcagtttaattttctctagcctatgaggcaagtgccaaggcatatgaagtatgcctataggtacaaaaatgaaagatgacattgaaagagtctttagacatggtagcctggaagatcgcaattagggcttttgctccatgaaagtatttttttcctttataaagggagatatctgttgaaattgtgggatagagattttaaagattgcatctgcttccaaactaaggtcaaaagttaaattgtagtaaatgtgtgcagtgtggtatcattaaactgtacacacatacgtgaaattgttgttttaatctggcatcttttttttttttttgagatggagtctccctgtgtcgcccaggctggagtgcagtggcgctctctcagctcactgcaacctccgcctcctagcatcaaccgattctcttgcctcagcctccctactagctgggattacaggcacgtgacaccacatcttgctaatgtttgtatttttagtagagacggggtttcaccatgttggccaggctggtctcaaactcctgacctcaggtgatccactcacctcggcctcccaaagtgctgggattacaggcgtgagccaccacgcccggccttaatctggcattcttaaaaaaatcagttatttagctttcttccccctcttctcctgccccatttcatttctttctgtagctgtgagggtcattctctctttgtatctgtttcactctcagggtgactcttttttcagtccacctgactgcactcactttcctttttccaggctctccgtggatccatatccttctatcacattcatctgccactgcatcttgcccttgtccccgtttgccagtgttaacaattaccccaccctgggctgggccagggctgtttttcagcttaggccgggcagggaagctgatctccagggcagatgtggagtgagaagagttgttgtcactctatacagaaatgtcattgacagaataggattaaacaaaatatgtacagagattacataggctatgtatacatgtaaacttgtgaacacaaaatcattccttctttacagctagggtcccagcaaatgctacagctacatgaaataatgagtatggatacctattgccgagggcttactatttgaacaagtgagagaattgtactcttgcctaggggtgtatttttaagtagtttttgctcctgttccttattattgcctgctaatggatacgtatattgtcagtaagtgaccaactctcctagcttcctgtagtacactgtatttctcttctgaaaatggattttcctctgtatttaaaccacagatttacttgtgcctcatttttgaactactatagataaaaactcacagataggaaatacctgtggactgtttgaaatgcagtgaaacctagaaaaaaaaaaacaatcaaaataataagtatctcctgtcggcattttactgcttgtagaattgatattctatttgcccacataaaatctctctggatgttattcctattgcaagacatagtagcttttcttcctgttccttattattgcctgctaatggatatgtacattgtcagtaagtgaccggctctccacagcttcctatagtacactatttctcttctgaaaatggattcctctgtatttaaactactgagatttatttgtgcctcatttttgaactactatagataaaaaaggcacagataggaaatacctgtggactgtttttgaaatgcattgaaacctagaaaaagaaaataacaatcaaaataataaatatctcttgtaagcattttactgtttctttttacccacataaaaactgtctggatgttattcctgttgcaagacattaaatgttctatagccttttttttttttttttgagacggagtttcgctcttgttgcccaggctggagtgcaatggtacaatcatggctcactacaacctctgcctccgggttcaagcgattctcctgcctcagcctcccaagtagctgggactacaggcacccaccaccatgcccagctaatttttgtatttttggtagtgacggggtttcactgtgttggtcaggctgatctcgaactcctgacatcaggtgatccgccctcctcggcctcccaaattgctgggattgcaggcgtgagctgttctgtagactttctaataacaagaatttgtaacagtcacaaggttttaaatttccttttcagtactaaggaaatgatagctgggaatgcaaaggctttattggcaagattgttttgacaaggatggcacaaaactaaatttctatacttgattaatttataagtcttgtcactcacttttagttttagagtgtggataaagctgtttgattcttgtcagatttgaaatgtatgatttatgagacattaaggattggtttttcagtgcactctgccaggtctagttttatgcgtcattctggtttgggaagctgagtgcaagtctgcctacagacataatcaatcacctgcactttcgggtggccaggtggactgaagtaacaggtttccccccaggtttctcagagactaaggaatacacacacacacacacacacacacacacacataggcagacctgcaaattatcggtccaaaaatatttatatcactaagccagagcagtggatttagacatttgacttaacaaaatttgtttttcaacacgttctagcaactaccctgtaaatgatcgtcatttcacctacaacaatgaaaagataaagtcctcagccgcatagcttctagaggctaaagaggcacgttaagttgcttgtcaaagactccacaccttcagatgccagggtcaacacaagttttcaaaccctagacccaatcccttctaggccacagaaggtctgcctcttgtaaggaaggaattttccaatgcactaagcacagctaatcacactaaggaaagaaaccaagcagccaaactaatatgaggaagtgaaagtttatacttgcatcttatagcagatggcctttgttagagccacttttaaaatatcaacttcaccgagcatgatttaggtacaaaaaccggcatccaattaaagcctccaatttgatgagtttagacagatgtatatacccatgaaaccactgccccaatcaggatgtggaatgtttttatcacctccacaagtttatccttgccccttttccagtaacattcttcccccagcccctttcccccagatatcccgttatgcttttgtgtgagagccactttcaaaactcagatttgaaagtttgtggatcttcctctataaaaagactatatttatgtccaaaatgcaattgtcttctctatgtttaaaataatactacagagaaattctaggtattgatttcctagaatctttccctcatcctctgcaagtaagctacttagtaaatagtttcattatgtacttgaattgaagagaaattacagccaagagaaaaacaattctgatagacagaaaagcagtgtatgttcttctcaagtagttacagtgaggtgttaaatccctcaagaaccagagaagtaaaatttgaattttgcttcgtacttatttgtaaagtaaaaatgaagactgagaataaaggttttatatgtatctatctgtctaatcattcatccatccacccatccctccagctagtgtgtgtatatatgtttctgtataaaattactatgtattaataaccctatcccttgaggattacaaaagatttgaaggcttcagagggaattttctgtgcatgaaaggtgtactgtctttacacacttaggtgcaaagcaagcttttcatatgctgttattactctcattgatatatttaattgaactaataattattgagcaatttaaaggctgctgcattgagatggagtttgtcccttcgtttgtcaccttctagaaaaatccaagtgtcaaaaaatatctcgctggctctctgttctgttgctattacttcggcatgcgtcgtctcctcttgccactctcgatttctactgtttctgccctatcttccttccctgattttcctcctccatgtctttcccgtatcctgatgccacttctcttgcactgctctgatttctcatgagaaagccatttttataaacatctccagaccgagagggcagcagactaattccaatgtgtcagatagcatcttggaggctgtttctcctgtgatccaacacttttttcacactcctttccagtttcgagctgtactggaaattggagagttgtgaaaggatggtttttggataatcaaagttgaatatacttgctgggctgtgttatgaccgtctttgaagccacgaatcattaaaaataagtgaatagtttacattataatattcctaggaaacttcctttgataattgtaaagcaattaaaattgtcctgagataaggtgatttattgtttttcagaatgggccataaagatattaaagaacccattcaacatttgtcaaaacccataaaatgcacaacgcaatgaatgaaccctaatgtaaaccctagactttagttcattataatgtattaacgttggcccatcaattgggacaaatgtaccacatcaatacaagatattaataataggggaaactgggagatggatgctaaggaggtatacagaaactcagtacttcctgcttagtttttctgtaaacctaaaactgctaaaaaaaaaaaaagtctactaattaaaaaaaaaaactcttcaaatgtatgggtttcagaaatacaaagactagatcaggagctttttattattaccgtgtggattaaagtctactgtttgtggccaggtacagtggctcatgcctgtaatcccagcaatctgggaggctgaggtgggtggatcacttaaggccaggagtttgagaccagcctggccaacatgatgaaaccctgtctctactgaaaatacaaaaattagccgggtgtggtggcatgtgcctgtattcccagctattcgggtggttgaggtgggagaatcacttaaacgcgggaggcagaggttgcggtgaaccgagatcacgccactgtactccaacctgggagacagagtgagaccctgtcttaaataaatacataaataaataaataaattccagtgtttgtttttcagaatgagtgaaataagagatgtgtttctccttgagtgatgtaacttgtggcacgagcccctgaaaaggggaagtatgaggttccaggagagctgcccagtacctccaatgctatgtctagttgcacaatagtcagtagataggtcagtgggagcagtgggttgggacttcgcttgccacccttgaaacatcatgccatctttgcagtggagtcccagatttggcaaattccctgccctacaacccagtgggccctcttttgacccttgcatttgtggtatcattagcaacagtgacagttggtgaacttatgccaactctgagccaatatccaggtcagagtttgattgctttgggccaaaggctattattgcatggcttgtagaagcataggcccaatgccagaacttccatgcacttactcagtatggccagctctacagtaaacgtgtgtgaaaagattcggtttttataggcattaatgtaaatagtttctttatattggacctgggtaactatgatgggcaattacaagtacccattgctttcctgagttggctatgagaacagaacattctgtggtacgtggtagtgggggtgaggggaggatcaggtctaagagggacattgcagctgcaaagggaaagaaaaaaactgagaagccatcaaggattagaaggcaaatgggagccatcactcaagcactgtgtatcttgaagtggttgtctgtcaggtctgtgataagacctggggtgaaaaacctcatagttcatgtgattatctgaaaaataccaataaagggaagagttgattatagagttcgcctgtttagtttttttgtttgtttgtttgttttttttgaaactgtgtcttgctctgtcacacaggctggaaaacagtgacgatcgtggctcactgcagtcttgacctcctgggcgcaaacaatccctctgcttcagcctcctgagtagctgggactgcaggtgtgcatcaccacacccatctaatgttttagtttcgtagaggcagggtctcgctatattgtccaggctggtctcaaactcatggcttgtttagcttattaaactttattttgtatattggaaataattctttgtgtacagatctgttaggtgtcctcattgttacatctattgttagacagaattttatttttcttaatttcattggttgcctgaattgactatatatgtggtaccacctgttaaaagcagattttgatgaggaaggggagaaagaggataaaaataacctctccctcaagtcccatttcatgatggaagctaggattccagttcagtggccaggctaaatggtcacttgatgccagtagtgagctactgccactggatttctttcagtcagcttcacaatcgacaccaaatcctgcagctgacgtgactttactgcaattcatgttgattggaaaaatggcaaaagtcaccatctaacccaatcataatatgtttgtttcccagatatagacaggctgggttcgtcattaggcctagtgtagtcatgctccctaactactgtgagtatctggaaggattggggaggtatagtggcagcggcttgtgggacaggcatgtgacagcatccttttgcccccttgctgctcacccacctgcttcttgccacctattggctcctctttgtcttcccctcattctgtcttctctttatccttaatccagttacttttgaattttctgttaaggaaccaggagagcctcagcatgaaaataattggcttaagtattcaaagtaccagagcaacatactttataattcttggactgcctgattgttactgctgcagtggtttgttgggtattaaatgagacttagggtattttgtaaacgttttctgacatacaatttgaaagttgaattttgtcaccttacaaacttagttattcctgcaacttttaaaacccccctaaattttccttatgtgttcatgattatccccatagcagataatggccacatgcgtgctgatatgaaggatttgctccagggctaattgatgggagcagagctgcccagttgctgaattgtaaggaaacagttcatggagcgccaatgccaatttaggaaaagtatggggctgagtacttagtaagatgaaataaaaaaatatttatccagtgcttactctaaggagaaggcacttggctaggtttgctagatgctgtggggagccttaaaacaacagtgatctcttcaaggccgggcgtggtggctcatgcctgtaatcccagcactttgggaggccgaggcaggcggatcacttgaggtcaggagtttgagaccagcatggacaatatggtgaaaccccgtttctactaaaaatacaaacattagctgggtgtggtggcatctgcctgtggtcccagctactcaggaggctgaggcaggaggatcacttgaacctgggatatggaggtggcagtgagatgagattgtgccactccactccagcctgggcgacagagagagaccctgtctcaaaaaaaaaaaaaaaaaaaaagtactagcgatctcttcaagcaaagaacgcccattctaattggagaagctgttaaagacacatgaaggatgtggtggaaagagtattgaactgcatagggtgtggggagagagtcaggagttttgaatcctagcctgagttctgccactaagcattggaaactctgggcaaatcatctccccactctgggtctcagtttataaaaaggcaaatgaacgagatcatctctaagatattctgtagattgattcataaatgtggaagagattctggaaaacggaagcttgagcccaggagttccagaccagcctgggcaacatggtgagactctgtctctacaaaaaatacaaaacattagcctggtgaggtgatgtgtgtttgtagtccctgtttctcaggaggctgaggtgggaggatcacatgggcccaggaggctgcagtgagctatcacctgggagcttgttagaaatgcaactttcatgggccccactccagacctagggaatcagaaacgctggggatggggccccgccatctgtgtcctaacaaggtcctctctcaggagattttgaggcacaataaagtctgacaattacaggctataggaatttgggtcagtggttctcagcctctgccatacaatagattcatctgggggaactttgttgggggtggggcgctgactttgtttgtgctgctgtaacagaatatctgagactggataccttataaagaacagaaatctatttctcacggttctggagactgggaagtcccaagatcaaggtgcaaacaggttcgattgttaagggctgctctctgcttccaagatgacactttagttctccagcctccagaggggaggaacgccctgccctcatgtggcggaaggcagaagggcaagagagccaaaggctctgttgaagctttaatcccatccaccagggaggagctctcccggtttaatcaccccacctcttagaggccccacctctcaataccatcacattgtccattaagattcaacacctgaatcttggacacatgaaaaccgtagcaggcacccaggcatcactagttgctttggctctccaggtgccgccaattttgagaatcactggtttaggggaaagtggcatgaaccaagacttctgtcattctctagctgcaatgaacgtcagatgcagggagtcagccaaagccagaggcttgaatttcactcaaagaaacttggcctttagattacaatggagaaaggtttttggcaatgggagtgatacatccgaggtggaacatttgagagatgattctgatgctagctatgtgaagaagagggcatacccatagttaagaaatctgatgaaatagtctggtgtgaagtgataatgggccaaattaggaccttagaaatgaaattataaggaagaaaatgtatgaaagctcttttgcaggaaaaatgggcagggtttggcgatggttgctggggtgacagcaatgttagaatgtctttggttcaggagtacctctcagacttctgggagggccagtgctctctagatgcatctggcaaaattgtcatgtatggatctgtacaattctttgttttttgttgctttgatttaggagttataatgcggaggtgacccacagcaagttatagaaaaatacagaattacagtcacctcaaaagctactcatggtcatcatgtcagagggaaaaaatgctgtttttcttttaaggaaagaatgcttggagttgtgggaaagttgtagacttggcaatgagtaattcaagcctatcagtcaattaagtgagtttttattttatcatttgttttatttgggagctgctgtaatagtcattgagaggacatcagtcttcatatttttaaaacaaaacaaaaataccattgaacattagggcaaaggacaagaatttcaaggtttttaccttttgacttcagcaaatatttgctgctccatttttcttgctagattttgccatttgacttgtgtttttcctttgttccaatttgttctttgtgcttgataactgtagtgtactctatttttttttttttgagacacagtcttgctcttttgcccaggttggagtacagtggtgcaatctcggctcactgcaacctctgcctcctggattcaagtgattctcgtgtctcggcctcccaagtagctggaattacaggcacgcaccaccatgtctggctcatttttgtattttcagtagagatggggcttcaccatgttggccaggctggtctcgacctcccaaagtgctgggattacaggcgtgcatcactgctccttgcctctattctattttcgatggcttttttattcataagtattcttaaggttttaatattccagttaaaaaataaatatatttgtccctttatgtttttccccaatatacttattcttcctttatgaccaaaaattattcaaatttgcatccagaaatggctcacagaaagagctccttggtatttatttagggcatggtgggaccttttgttagtttctaggtcatgccacatctggaaggaaagacaccttttatttactaatttgaaaatctatgaaagcagactcagtattttacagggttgcatatattcctatgcaaagttgcatatattcctatgcaaagttaaaaatgactcactactccaactttggtaaatgtgtgcactttagtttttgaaagaagtgcaaaaatctgcagaaaaatctggactaatcataacttgaaatttttagtatatctggtagataacttttaaaaatataacccatcttttcccaaactggatagggataattcctctctttgcaaattgtgaggaatattatgattgtatcatataaaataaatatagaaacgtgtagaataaatgatcttccagagtatatagaggatatcaccagataatactctgtactaaatataaggacacaaaactggactttattatatttctataactggtaatatccttccagtttttgcttgtttattaaatgaatatactgttaaagatttggttatgttgtagatcttaattatgttggaattattaaaaatgaggcatctttaatctgtactgcttatttccaataaattattttgccgaatgagagccagtttaccagttcttttgttaaagaaaatgagccagtggctacctcagttgtatttatcattgccttttatggtaaacatttaaaatgtgtttttaatggtgcacatgccgatgtttctgacctctatagtagcataagtatttgaataaaagtgaggtaaatgagaagtctgtgccacccagtctcatcacaagtgtacctaattaagaagatgtttggaattcactgttctttgatttcttgggtgggagagaatattctgaaggctgtgattaaggaatcgttaccatgacaatcacattcaaagaattgagaggagacaatgagtctgtgggggatcatctcttttgattgatttgactcttcttttaagttctttcaaacagctgttgtcactggattttcttttccacgtaattcacacaattgattggtgatgtggggatcattgaagcttggttgtcagtagtgataagggtcagcagtgtccatgaccacaatacttttgctaaacctggagagtgattgtatgtgttaaatgtcactaaaaagtaactcttggcttctttctggaataatatatgtggtttgtctattttcacttattaattttgtcagggtgggatatgattatcatgatctctttgaaagcatgactaactctaaagtgtttgagctttattttggattactttgctgtcatcttacccagtgttttgtgtgctgttttgtttttattctttaacttgcacaatgttgtcaacgtaatttatatgatgttctggtcagagacacagttacacgctgcagattgaaaagtacacacaaatatacccaccatgagtgcttcagcctcacgaccccagctcatgttaagtgggacatgctagtacagatgataaagtgaaatggagatacaaaggcagttcagatctgactgtcaatttttctcctttgtggactaattctgggtggtgaaaccatgaactatggaacgaagactgctccagcatgagtctgagttgaatcccatgtgagagctttgcctcctcagcctttgggcctttctttcttctgccctctggagggtgtcagagaacatgaaatgcaaggactttctggaaaggatagccagggtttggtctggtaactagaagacactttccctgccccttccccaccaccccctccaagccggaacatgtagaggtgaggagcagacagagagatggcagggaagccattggcaaggtgggaatcttaggaaggaagtgattccggttcttgaaaaagacaaccggattccattaagtagaatcggtatgaattgtactcatctctaggaaaaatcaattccagaagggtgagtaagatgaaatatgataagactagtgtgtgacagattcaggtttgaagcttaaggtggatggaatcgaaagaaaggtatatttggtgtcaagtgtttgtggcggcatgtgaaatcattatccacgtttgataacagtttgactctttgcctgctataataatagtagtaagtatgtatttaacattcaatgcgtaccttgtgtgggggaggcactgctaaatgctttgcatggacgtacctccttacctctatgaggtaggtggccattatgatgctcatagaggctggacagctaatatgaggcggagcctgtatttgggctcaggcagtctgactctggtgcccctgctgtgaagagctgtgccctgctgcattcctcctgtagctgcacgaaagggtgtggaatcttctagaaacagtgagttctatatgagtggagtgtggtggtgggagaatagatggagtaaagccttttgtgtaaacataccatgctaagtactgggagatagaaacgaaatgagagatttttttgttttgttttttgagatggagtcttgctctgtcgctcaggctggagtgcagtggtgcgatctcagatcaccgcaacctccaccttccaggttcaagcaattctcctgcctcagcctcctgagtacctgggactacagacacacgccaccacgccggctaatttttgtatttttttggtagagacggggtttcatcatgttggccaggatggtcttgatctcatgacctcgtgatccacccaccgcagcctcccaaagtgctgggattacaggtgccagccaccacacccagccaaaataagacatttctttgcccctgccaccaagatatttaacatcttacaggactaacaaaacctaacatgaaccagtccagattcatatgatagaatatgaaaatgttttctggaaagaatagccagagtcccagtctggttactagaagacactttccctgtcctttccccacctgtagcccttccaagctggaatgtgcagaggtgaggaacagacagagagatggcagggaagctattggcaaggtgggaatcttaggaaggaagtgattccggttcttgaaaaagagaaccggattccgtcaagtagaatcggtatgaattgtacccatctctaggaaacatcaattccagaagggtgaattagatgaaatatgataagactagtgtgtgacagattcaggtttgacgcttcagttggattgaatcgaaagagaggtatatttggtatcaggcgtttgtggtggcatgtgaaatcattatccacgtttgataacagtttgactttttgcctgctgtaataatagtagtaagtatgtatttaacattcaatgggtaccttgtgtgggggaggccctgctaaatgctttacatggacgtacgtccttacctctatgaggtaggtggccattatgatgctcatagaggctggacagctaatatgaggcggagccggtatttgagctcaggcagtctgactctggtgcccctgctgtgaagagctgtgccctgctgcattcctcctgtagctgcacgaaagggtgtggaatcttctagaagcagtgagttctatatgagtggagtgtggtggtgggagatgagatggagtaaagcctttggtgtaaacataccatgctaaatactaggagatagaaatgaaataagaaatatttcttcctgacaccaagatacttaacattttaccggacaaagaaaacctaacatgaaacaatccagattcatatgatagaatatgaagatactgtctctacttaagtacaggtgggaggaagactggaagatgttcctttgaattaagtcactttaaaacatttgctttcaaatgttagcgcttcaccatgggcacaaaatttgtcttcctccaggcttttggcctggcaaacaagaaccctgtccctatagtcagcagattcatccattttgagttgggaagcattatcttcagccttttcttcctgacaacgatcctgacaatcgtcgtcaggatctctaaagagatgaactcattagcctagtgaaccaacagtctcagctgtttatttaccagcacattaacagtttttccatttatatccactgcctgtgtgacgatcagcctggaaatggtttgagcatagggtgggaggggtggttacacacctggttgtaatccttggtttatttttgccctgtttccatctatacttcttgagagcttcctgtgttacaggcactgacctgggtgttggggcagagtagtgaaaaaacagactgggtcccccgcccaaggcactgtcttttcctcagatttcattcgctcatgtacattttcatagttgatctaaaagcggcatttggtgtgaattctaggatttcacacttttaggataatacagtgatcacactccctttctcctttgccccagccagtcctttctgaataaaggtcgagggattgggggaggaaggcagtgatgcgaatgggcctgtggggaggtcgcacgggcttgaggagggcagcatgtcgtagcgggccatatttgtgtcagggttgggaacggcacaaggcacacctgtttcctagtgctgcagaaccctcgtcctgggatgagcctgcccgctagtctgcatcctaatcctgctgttgattggagataacttcagcggtcacagggcacctcgtctccatggcaacccctctaaatattcctctagtgacttgtgctctacattctggctggatcagagccctcctgtggcaaaatattctaaagatgttaaaagagagagagagaaaaaaaaaggctcaactaataaatctattctaaacgactgagtcatttgttttgattacccgggtgattgccaaatgttaatttaaaactgaaataggccatgagctcactcccctaacaatgctgagtgtttgagctaatacggcttgataatgagggagccagatccactgccagtgctcatgttatatgataaacagacatttggagaagtatgcagaacatcttggcagttttcctttaactctaagggttgtaaatacaaagtagaatgtgttaccatgagccatttcataggaagttgactttatttttttagaattcagaactttgcttctaaaaaggtaactttgcctcttgattctcatttttttccctaacttaggcaccttggaagttgttttcaaccatatccagcctttgccgaatacatcctatctgccacacatccagcgtgaggtaagttttactaattgccacaaattcttacactgatctccaaccttctaagttgtggtattaggggcggcattgtacaaagggctttatttgtaccaggaggtttcagaaggttcattttaattgactcaaccaatgtcactgcttaccctaaatattagctctcgggggcaatgtcttttcaagggaaaatctcatttgctttcaacttgggcatatgaaaagggaatttgccaggcacaacagaactatttgaatgtctgctttaaagtaaagatctgctcatgtcgttgcacgaacagtagggagcaggaaagctgcatggagcaaatgctgggatgggacagaggagactcctgctgccagccacgagaaggttaggctgacctgatcagctattaggaatctttctccctgggtggaaggagccaaggtgcaggactggcattgcaaaatctggtgatagaaggccaaagagtgcttctgctcggtgacattaatagggtccaggagattttcttctgatttgccctcaagttcagaacaacctgtgggaagccagtgtaagaatgcttatactggataagcgttctctgtcctcttcatttagccacagtggcttgtttatactctgtgatgactcagggttcctcaattttctctttgagagagggacattgacctttgaaaataatgaaggaatctaagagaaggctcatccaggcacgatacagtaatggtccctcctttttggtgccccggtctctgtgcgctcacaagagggaatgtaacctttgccagcaccatacctgtcaggctttgccatttcatccctcaaaaggttgctgcgtttttgccttcaccttcaccctgcccacccctgcatgcagccacatggtcagtgtaggtacttagatttcagttagggtacatgctcagcaggtgacaagaattgcctttgttatgtctacttgctacagaattctccccaggttttaaaatatatatcttcaaatacctaaatgtattaaaccttaaagagtaaaaagcataggacaaacttttagaaatgctaaacctgaattttatccatttcatcaattatggtggtagtcggaagtccttccaaggccctcgggcttgaagcaagctcggtgatacaagctttcagcagcttccctctgctgctggagatggaatcttcatttctgggtctaaatcctgccatagctctcattcatagcctttacctataatggttgttttcaaacttaaaaaaaatgatagaaacctatcttcaaaaaatacaaatctttagatctaaccccaatagagaaaaccaaagctgaactgctttggctcaagtaggaggctgtgactctctgtcaccctcctctaagggtgaaccctattgaaagagcagagattttagctctgtgccctttcccagctcttatttttattttcccacagaagaggctagattctttaaggagatataaagaagggagagagaaagatataaagattctttaaggagatacaaagacatcctctcatcagctggaaatgccagctaggtgagacctgactatgcatatgcattgtttgcccttagtaattccatagcaatctgcaaattcaatcagcttcatcagcagaaaactttgatagaaaccatgtgtaaaagggctgtgttcttaaagtggaacatttaaatcgaagtttttcaagcacacatttcaagtggttttatgataccaagcacaccccagtgacatctttacattgaccaaaacttggtatccttgggttttcttttaaagcactgagtttctcaggtgtgtcagttgaatagaatctgctaaattctgttttttttatttttttaaattttttattgatttatttttttttatggagtcttgctttgtcgctcaggctggagtgcagtggtgcaagtgcagtggtgcgatctggctcagtgcaacctccgtctcccaggttcaagcaattctcctgcctcagcctcccaaatacctgggattacaagcgtctctacatcaacatgcctggctaatttttgtaattttagtagagacagggtttcatcatgttggctaggctggtctcaaactcctggcctcaagcgatccgccctccttggcctcccaaagtgctgggattacaggcgtgagccactgcgcccggccaaatctgttaaattctgtttccatgtaacagaaatatataggattacacaactgcatctggtgttctttcttcctttcttttattcattcattcagccctactatgggccagggcaggaatgtagtggtgagcacaaaaacaacaaaaaaataccttttgggtttgatattcttcaagggtgggacatgcctagattattttctcttttgcagacaaggaaactgaaaattgctttgcttttctcaattacattgcccagtattcagtagacaggtatggatgcaggggtacagttccaagtccccatctctactctattctttgagcctatgatttatgccacttccatataagcatgtgcaaataaagtattcagtaattgccatggatgcagctgtccctgggacccgaaggccctaaaatgaaaataaatgtaaactgtgcgtttcacactctatttttaaaacgtttgtttggaataattgaatagtttagtaaaatgggctttgctgtttccacatgaggatatcttgttcttttattttttattttttttgagacggagtctcactctgtcgcccaggctggagtgcagtggtgcaatctcggctcactgcaatctgtacctcccaggttcaagcgattctcctgcctcagcctcccaagtagctgggattacagatgcgtgccaccatgcctagctaatttttgtatttttagtggagacggggtttcaccatgttggccaggctggtctcgaactccttacctcaagtgatccgcctgctttggcctcccaaagtgctgggattacaggcgtgagccaccatgcccggcctattttgttcttttaagtgatggtgtgtccccttttaatacagtatttatcatagataaactttattattcagaaacttagaattattccatttggctgccttttagtttacagaattatttggaacacaagcttgaacacataattcttaacacatacgtgaactgggctaaatttgagtatttgtaccatagtagtgacaatattgttaattaaacatgtgtttcacatgtaggagatatttgtatcactgacatatggtcattttcattattgatttggcagttttttaatattcacaaaacacaaaattttgaaatacagtagtcaaagtgatttgatctgtgccatttgtattgatgtaacctctcttcttggtgcactagcaataagaaggagaatcagcacagatgggttacacagacttagaggatttggaaaccatcactttagagccaaggtctcaaactgatgggctggatctggcacacagaggtgttcttttaaaattttaattgccagcatttaaaaattgaaaggtttcatattttttgaagtccaaatttttcagcttctcttgaaatatcagaagatctggcaatattgagccctcactcctgtttggctacactaggctggagccaaatggctgctgtttcttttctttttttttttttttttcctgagatggagtctcgctctgtcacccaggctggagtgcagtggcgtgatctccgctcattataagctctgcctcccaggttcacgccattctcctgcctcagcctccccagtagctgggactataggtgcccgcaccacgcccggctaattttttgtattttttagtagagacggggtttcaccatgttagccagaatagtctggatctcctgaccttgtgatccgcccacttcggcctcccaaagtgctaggattacaggcgtgagcccccgcacctagccagctgctgtttctttagctagagcatgaactctgaagtttgccacagtctctggcagtatctgtaatctccttgacactaaggacaagggttggttgccattatctgaatgtttaacccctatagacatgtgagttttcaatcccaggtctagataaaattgaggttgcaaacttaaggtcatcctttttctcaagatatcagcttgctaattttcaggggcacgacatagggtgacagtcatattaaggaggtgctttaaaagggttgagggcaaacatttcagaggaaggttactttctgatgatggtacctgattaagaaaaggatacatcgacaggtacgggtgatttattttattctggcagattcctgtagtctactttggtgcttctcacactttaatgtgcagattctgatgcagcaggtctagagtagggcctgagatcctgcatttccaacaagcgccaggttataccactgctgatctgaggacctccctctctttgagtagcaaggggactctaaaagcaatcctaagaaaaatcagtcaggcagtgatggtgctaatgtttagaacattcacttttctctagcctgagaaagaaaaagagatacgaaccagggtattttgggttgaatcttcccagataaatctggatctactttgagttggagcagaggagatgaaaaatcaattattttcaatacagtatagcacatgggaaagataaatctaactctgattttaaaatttgttttaaattaagtgcttctggtaaaaaaaaagctagatatgctcaggaatcatgaaatgtagggattagagcttttaattttaggaaaatatggggctgttagcaaacttgtaaatcagaccacagaaaataggataattatcaaatccctggttatatgataaccttgtaagctataaaatgattttaaaaagttggaaagaaagaaatcaacagtttcaaatatatacagtcctatattgaaaagtataattaaaatgaaaaagcacaccaggaaaaatctgtggcacagatgacaagatacataatttctatatcatgcacagacctcatacagattgtaagaaaggtgcgcacaggcctagcacgtggtaggtgcttcctaactgttggctgaatgaattatccaattgatagatgggtaaaagacactcaagttatatcacaatgtaaagaaatgcatggaaaacactcagcctcactggtatgcaaagataagcatatttgaacgtcagcaaggcacacttttactaagttagcagaattacaaaaagaaaacacaatgttaatatggttaacttgaaatggatatgcacttattcactgctggtagcaaagtaagttggtacaaagccttttggaacattgtttggcaatatatgcctaaaggcacaaagattggtaccctttaatctagtaatcatactttgggaaatgtgttctgagaaacaaattattctaagaaaagaaaaaaagctgtgtaagcattcatcacagtgttatttgtgaggacaaaaagaaagaatttaaatgtctaatgtgaaaaaaatagttcatttattcaataaatagttttgattgagtagattatgatacatctatgcagtggaatttcatgaatctgttaattataattttcacacttacattagcaatatgaaagaatttgtataatacagtcttactaaaaaatgcaggatgcaaaattgtatatatgctgtgattgtaacttgcaaagtgatatgtacctgtggacaagaactagaaggcacaaggaaaaaatgtaagtatcactttatttgaagttgtattcatgttgtgatgttgtttgtacattttgctattacttagatgttgagaatcttccacttttatgtacttaactccatatcacaagccggatattctaatctatcacagagtgcttagtaagtaaccaagaaacatgaggactcctgtctagagcctaaacatggggttccagtgctctagttccttctcgcttgttgtgtttcatcatccagagcccccatttctctttcttccgtatttggtggttggtagaggcatcttggtatataccacatgacaccaagtataaatatttgtttcagagcttttaatgaatgtctagcagtgccaggcagggaatgaattttcatgtttaaaggtccagtgtccacttaaggaacatcttaatggagctacagctcaagagcaagcccatttcatcttctgatttccattagataagcaacaaaaattggctttaaggtcatgagcctccttacagcagtccctctcaccttcagctgtattccctatttcagatatacttgtttctctgctgtaagtacacttttcttttctaattaggtcagttacttcatgtctgtttttcttttttgacatggtttcttctggctttggcaccacatattttccccatatgtcattgcctctggagcttcatgttgcaatagtttttcaaggggaacggagagcacattgctaagggtgggggatggcttttgcctcttttgcctgccctttgcttcagtgagtgttcgtatttctgttgggcctagttctgtttggttttgtagtcttcagagtcagttatgtttggactgaaagatacttaagtaaaaataatggcaagtcagagatatgtctggcaaaggtgcagcacatttgttaaggttactggtttatttatctcccttgtctctatggtgactaaatctgggtctgggatttaatggacttagttttgacctcttgtaacatctcctaacttttcccagcctctgatttagaaagaattcattttcacttgaggagagaaactgtctcacttagaaaaggggtcctaactggactctcgaaaagtggaatctctagtctttgattcttacacagtcttcaaccagagtacccattgtggttgtaaagaaagctaagaagtcatgtagaaatacacacacacacacacacacacacacacacacataatgtctcaaggaaatacttttctttttagtgaaataaagtattatttagttaatgtgaatgaactgtctgtaaagagaaccttttgtcagaataccaaatcaatggaaccattgactggacattatgtttttattttttaaaagtatctcctttacccattacaggattataaatttgcacacatataaatgtttgaaccatatttcagagttcaagtgtattaaattgtgccatggaagtccacaataaagattgggtttgaccaggattctcatggaagaagtcagatttggacagctaagttcaaatctagtgttccatcttcacaattgatgtgaaatgaggacatagatatctgatctctaaggtaggtagagtcaaaccatcttggacttcagttggttcaaatgagcctttaaaactttttctcttctcctgtatggtgctttgagacttataaaaacattccagctgtaagaatttactaatttgttcatctgtttacaggtcttttcagcttctctaagaataagctcacatgtgaattttctttgaaaccccaaaacaaaggagtcagtaaatgattgattatcaagtattgcacagagactgaggcaagggaagtgacaaaagtcctcttctgtccttactccccaagtataaaatattagagttcagatctgtcatcaagtttagttcaagcccaataggaacttgtgattacttagtaaggtttttgaacatcataaaagttcagtgcatatggaagttgttgtaagattttgtccatcatgaacgctcctattaataggcaaagatttgagaagccaacaacagatgctcacttgtaagagagaaccatgcctgggagatgaatgttggatgctccttaacttctgagtttgaaaccttgactcacttgtcttataaccgtggacgtagaatatttgttagattaaggtcatagctaagtcatacaaattttattatgatcagtacagtaagcatagctggggtcaaagcttttatggaaatcacaatgttaaggcctgaagtccttaataatgcttgagaaagaatggcacttttatcatcatcattatcattgtcatcatcattattatcatatcaaccttatatcacatgttgaaagcccagtgtggtgaactgtgctaataattgttataatttatgtatttcattattgatatttcaattttgtttgaacaactgtagggatcaatttaaaataaaaaggaggaaatatataaaaatgtatttagaatagtagcctcattgtcttgtcttatcagccagataagctttgtgctttgtagagcatctctcactgaaggatacctaattattggataaacaattagttctttaacagttcttaggctgggtgcagtggctcacgcctgtagtcccagctactcaggaggctgaggcatgagaatcgcttgatcccaggaggcagagggtgcagggtgcagagatcgcacgactacactccaacctgggtgatagagtgagactctgtcaaaaaaacaaacagacaaaacaacaacaacaacaacaacaaaacccaaaccaaagaacagttcttcacctaagtagaaaagcagaaaaacaatggtttgaggtctttgtgagtctgtggacatctcttaaaccatgtgtgagaggaccatttctttttctattctttttttttttttttgagacatagtctcactctgttgcccaggctggtgtgcaatgacgtgatcttgcctcactgcaacctcttgctcctgggttcaaatggttcttgtgcctcagcctcccgattagctgggactataggcgtgtgccaccaggcctggataattttttggtatttttagtagagacggggtttcaccatgttggctaggctggcctcgaactcctgacttcaagtgatccacccgccttggactcccaaagtgctgggattacaagcatgagccactgtgcccagccgataggaccatttctgtacacattcattagggctacaaattcataatttccataaggtactctctgtgtttctttcccaggaccggtagagtttttcctatgggtggtggtgagagtttgtgtacataattgtcagcgtgcacaggcatagggatttataatccagagggtcttttgctccctacagtggttcaaatggaaactaattggagagggtgagttccaccctttgcattgggctcatgggacaggtttgaactggaaaacagtacaacatgctccagtatttttagcctatcccttatgttcccagctctgccgtttgaactgtcagttctcatagacttcacataggatcttgacctgacttttggtcctctcgtgggtgttttccattttccttactggggcaatctaaggcacaaagagtaaaggatttggtcagagttactgtcttaaattgtactctgctttctccaggaaactggaagcttctgaggagcaagaagcctgatgtttcctcttatgtcctttgtatcatttattatttagtgccagagacttagtaggcatttgctagagatacaattaattgaatgaaaggcattatgtaaattacaaaccatagcattaccgtggtattacacaggactgtcttaggatccctgttcctctaatatccatattcctgaattgttggaggatatgcttgaatagaacaatcccttttccttcactgtagcatgacattatttcttcccggcctgttatcagcaagtttttcgaacagaaaagttgaaattatacagtgaacgctcctattcctaccacctagagtcagcaattaaacattttactatatttgctttatcaaatatccaccatttacccatcttaatttttggatgcatttcagagtacgctgaaggcatctgtacgctttacccctaaacacttcagctttatcattatgtggtttcaattttgactttcttagagctgctttcaaatttgttgagatcctgacatttattttggtggtggctaagaagacgtagtaactcaaatgtgcaatatgctcagttttcagaccctgggagtttctctttgtttgtaactaccagcaagtatacggacacatacatatcgctgtcccttccccgcttcgttatatggtcacattatttgtattgttgaaatttggaaagccagcctaggaaatgcagttgaggggcttgtggatatgaatgaaatcaaagaattggggttgagaatagtagggcaaaaggttagagttagctactataaagggaggatagagttgggtataaggagtggggaagagattcagatcaggaagttatcagcatgataccactttcatatatgaagtctagagagggtttggtggctgttcatatgacctaaaggtcatggattgaataaacactaagagtgcaaatagtccttccagtctagtggttttcatattgtattccatggaaccctagaatttatagacatgtctcagaggttttaccaacatttgaattatactttcgcaagtatattgaactatttttaaaaacactaataagaaaacccaacaaaaacacttgactgtgttttatagaaaattttatcatcctggagaacacatactgattgactttattttattttattttatttattatttttttgagacagagtctcactctctcgcccaggctggagtgcaaaggcgtgatctcggctcactgcaacctctgtctcccaggttgaagcgattctcctgcctcagcttcctgagtagctggaattacaggcgcttaccactacgcctggctaatttttgtatttttagtagagacggggttttgccatgttggccaggctggtcgtgaactcctgacttgaggtgaccccacccgccttggtcccccaaagtgctgggattacaggcgtgagccaccgcgcccggccctgattgactttaacataagtaaaggttattaatgtcaacctaaaataaagttttgactaacacttatctgtcatccatcaaagtcggggtagtatttctatgtgggaataaagacaaaaggtccacagcaggaccattacactaaagccatgggtgttaaggcattggcctgcaaaagctgaagttacgttttggtttccagttaccatgagcacttatccatctgttatatttagatttttttttctagtacctttaggaatctgcaaacagacgagtatctgctttaaacttgaaacgaccataaaaggagagagatggttaggatgccggaggctggctacactgtcatccttcagatgggcctgtgtgaatggattagggaaccttcaaaaaggtctctcttctggcccaaactgctcaacctggtctgaaaatgtatgtgtgcaatattgcacttcatgatgagatgtgatgttcagggcttctttaataatgcctagaaaaaccttaaaatgggcttggcagatttctttcatttggaggctgtggtactcaactttggtgtttttcattccagactgtaccacattctgtgcccatagtttgaaaaacattttggaagccaatacctgcttgtgtgtagctgcagtcagtttttaaaggttttgctgatgtatattttattttcccctaacctttattaagatcttcaaagttgaaatgactttgcagtggccatctttatccccatcatcaacaggctgccattaatagcattttattctacctgttttattactatctatccatccctccatccatcagtctatcttatttttggatgcatttcaaagtgaatgtagcagatttcaccagttaacttcataatattttatacacttgaagtctagctttttgaacagtacacaaatgtgactaaattgctatagaatgctgttaaagaaggtataaaataaatgccccagttttggaaaaaatttaggagccttattttaaaagtaacaggtattctggaatcctggcatggagttggaaaaaaatatactaatttttaaattggaacttttttgtaactctgacattgctgacccctaaaaaagaggggatacacttgtaaattttattttcatcccaggcaggagttaagtaacttcccgttcttatagagaggcaagatcatcttgaaaagtgttatagacatagaatgttggttacgcccacagaatcaattgcatttggaaggcagaggaacagttaactgaggactaagttgatctatgcagggtctgagtccaaaccctggtgtcaaggtgttaagtgcaaattattattattattttttaaagaaaacactcttgttacaatttggacagagagaatggtatggagatgaaaggttctcgtgtatggcttttgctcctatttatgtggaaagcacgccctacattctttcaaagctgtgttgttccctttattctcagtccccagaattgtgtgcaaacacactctcttggcccaggggtttggctgggtgtgtttccttctggaagtcttcactagcactcttgagttagctggcaggagatcccttaaaaccatttccaagcagtttttctcacttccctataggggctaatcctgtactttccacttcagttccagctgctgttgcttgggaagaaacaaatttctgctgtgttctcaatctccagacggtccatgaaaatttaatgtataagaacaaagaggctgggcgcagtggctaacgcctgtaatacctgcactttgggaggctgaggtgggtggatcacctgaggtcagaagttcgagagcagcctagccaacatggcgaaaccctgtctctactaaaaatacaaaaattagctgaacgtgatggtgggcgcctgtaatcccagctacttgggaggctgaggcaggagaatcgcttgaactcgggaggcagaggttgcagtgagccaagattgcgccactgcactccagcctgggcgacagagcgagactgtctcaaaaaaaaaaaaaacaaaaaacaaacaaacaaaaaaaaaacagaaaatatattttgggcagagattagttgggggatgtgggtgggaaacctggtgattagatatatttaaacgtgtcatgtcagtatagagcgtgaattaaaaataaattatatttggagagttgtaagaaatttaccagtcccttcagacagacacatgaccctttaaaactcattaaaactccttggcacaatggaataacatgcactttggtcttggaagaaaccattaggttgcaatgtttttgatttctctaccactgacttgctctttgatcttggaaagtgactgacttgtcctgtgattgtttcataatcacccataataaaactgacttactgtatatagtgaatagttaagtttaaaactatatctagtttccgttatagctcaagtttatgtattattttattagcgtttagatgttaacattaagctttcaaatcagatgaaatttaatttgaaaaaagttttcgtgtatgaatactttatattctgcagttcatacatgcagtaccacccttaattaaatgatatttccacaaatcagtttggaagattttcttcctgcaaaatgtatgtttaaaatacataaaaattgatgggaccatgtacttatggctagtcggaaagtggaaagttttttagatttatgcttaggacaggtgatagtacttgagcttctattcttagtttgaccttgcctcccccacccccttaaagcaagacacttaatctctttaatgtctcagtttattcatctttaacacctgtattcttatttcatgaaaacaatacctggtttatatttggtagcatttaaggacttgatatagaaggtggtatggaagttcaaattatatagaaagtatttgtatgctgaatgataatcttgacaaattactgattactacatttagaaagttacaactctggagggaattgatatttgatattgttttcctgtgtgttctaagttaccaccataacagtaggaaaataaaccctatcctggctgtgttacaaagggattaactcacttcttcaagttgttactaaatctccagccctttaaacaacagaaataaaaagtgttccttattttaatttttccgaaatgaaagtcctataactaaccttggcttaattttttcttttgttgagggctttccaagttattttctttgtgaggaatggaggctaaaccatgtcagttgcttgaagcaactaaaaataccccgtacaaatatgcagaggagtatgcttttgatttttagatcaaaacgaagaagcaagattttatggagcttgcttattatacatttattatactgagctacttgtgccttttcaaataattaaatattaactaaatacaagaggattaaatagctagactttaaataaaactaaaatagccatattagtattttctaaattctgtatcattgaaagtttaggctgatatgaaagagagggaattcctatcatggggattgccagtcttttcacaaagacctgccactagattttgtagtatatgataaatgtgtgtgtgtttattgtgaaaattgtgtgagtcatatgaaaaattaagtctacttgaaaaatcaaaagacattacctacttgggtacaaagcctgatttatatatatatttctttaatgaccatattatgttatgttaaagtttgtatagtacttggacatatattatttaatttcattcctaaaacaattcaatagggaaagcaagacagatattaatattcccatttcatagatgaggaagaaaaaataacttggcttgtaagcaattcagcagagtcagagattgcatttgagatttttgattctaagtctagtgtgctttccttgggttacaacacaataaagtcaaaaacatttactgttattttcattaattgaaagcttaaaatcaatttaaaattctaacagtataaaatttaacagtataaaaatattgttaatttaattttatgacgttaatttttaaattgatttttgaatttgctaaaagtgttttaaaatcagtatcctgtttcacaattcctgaattaatctcttctctgtacatttcctgttccagtatgataatttatataggctttagcatttacttatggtattaaatgagtagacagttggaagggaattaaaattaattaggtcttgcagttcttataatactcctggtttgccacactgaattgccatgacgtggctggggatccctgttttaacatctaacaaagatagctgccagtgtacttaattttaaaacggtctcatctattaagctgctttataaacatcagccccttttctgaagtccgaagttagttttttaaaatattcactgataatggagtgggggtgctggtgacgtttctctttcttgtttatctgtaaagacagggaggtgcaatctaagttaggaaattggtgacaaatagtcatagaacatgggtcacctggcttcaattagttatgtgacctttaagaaaacaagtgcccgtttcagaaaagactgacctttgaggctagagacatcaagctactcctctacttttaggaaaaaacaatgacagggttaatttaaaactctgatgcagacagagttgaaaaatccatgacagatttatataacgaacgtggatggtgttttgttttcccagaatgcagttttaaggtcagacctatgactcagagctgtgcacttccctggtggtatgcatcagtgacatgttgccagtctaatcgtccagaagggcttgtgcccagctcggcttgctccattataatccccagctgagaagccacctttcattttttttaaatagataaggaagacagcatgaacatttgaaactcaaatactatatgtagtttataacttttcagcctgaagacttgatgcacactaagttgcctctttaattttgagaagtataatctccattgccactaatccatcatggtgtggcactgcatgaggatatgttgtgtgcattgtcagtatcggcgttttgctgagtttactgttttttagttcattggcaaggcatcgtgggttttggtgcaaagagcatggatttggaatcaaaagccacttcctctctgggtggctgattagctgagggtaaccttcatatagctggcatgggatttccagatggcatcctctctgcatgaacaaaaacaatgtgccatttcagtaaactttggtgggtgctccctcatccactccagatcttttcatctctttccttttattccctccctttccttgtaaatcaaaactcccattcctttagtgctgctgatctcttttgggggttagaagaaagcagtctgattaaactaacttactactgtttttagttggttcatcctatctttaaaaaatgtatatatttcaaggctgggtgcagtggctcacatctgtactacccagcactttgggagaccgaggtgggtgggtcaggagttcgagagcagcctggccaacatggtgaaactcttttctctactaaaagtacaaaaattagctgggcatggtggcacgcacctttagttccagctactcaggaggctgaggcaggagaatcgcttgagcccgggaggcagaggttgcagtgagccgagatcgcaccattgcactccagcctgggcgacagagcgagactccatctcaaaaaaaaaaaaatatatatatatatatagatagatagatagatagatagatagatagatagatagatttcttacagcattgtgataacaaatatttgtcaataagagactaactgtggtatagctttacaattggatactatgtacatgttcaaaaagtagaagctctttacgtactgacaaggaaaattctctgaatataaataaatagaactagcaatagaattaatagaaaaagcaaggtgcagaggagtatgtatagtataccactatttatgtttttttttttaaaagaggaaaaagaaaaaatatatagctgcctatcttttataagcccagtatctccagaagcataaagaagacactggtatcattggttatcagtggagagggggaagtagatgtctggggatagatagggggaagaatacttttcactatgtattctttcatacttcttcaaaaatacatctttggaaataaacccatgcaaaaaaaagaatgttcacagcagtattatagtggctaaaaagtggaaataacccaaatgtccattacctgatgaatggttgaacaatatgtggtgtatctgtacaatggactattattcagccataaagagaactgaagtactgatgcatgctatagcatgaatgaacctcgaaaacattatactaagggaaagaaatctgccacaaaaagctgcatattgtgtgattccatttttatgaaagcattatgctaagtgaaagaaatcagccacagaaggccatatattgtatgattccattgccagaagtggcacatccataaagacagaaagtaggttagtggttcccacggggtgggggtggggtatgcagagtgatggctaagaggtccaggatttctttgggggtgatgaaaatgcagaatcagatggtggtaatgattgatatacattatgaatatactaaaagctgctgaattgtacactttataaaggtgaattttatgatatataaattattttaaattttacttagagatggggatctcactatgttgcccaggctagtcttgaactcctggcttcaagcaatccttctgccttggcctcccaaagcacaggcatgtaaattatatctcaataaataaaataacatagcaaaacaacttgaagtcatgaacatggaaacttaaagaatcactgtgaacatataaaacaaaagttttcacctaagaaatgtttttattctaaaatattttacatattatctctataatgacaaaggacttcatgttctttagctaccttcactcacactcacctggaattatttcattttataagtgaagattgttaacccaaatgaagccctgattgataaaattttgggtaaaataactaaagaaagaatgtgtgattatctggaattgagatgttgtagctgcaggccttgcccaggctgtgccagtaggagaggaggtacggagcctcagagaatcttttggaccagtgtgccctttctctcctcacagctcatcccagagctgtccctgcctccttaggctgatatgcccctgttcccttccttgtgttctcctgcagtgagctgaggcacagggtttagggagcctattatgataggaggagattaactttggggttctgggatgagatctgtggacctgaaaatatagcctctctgatcctagtcactaactgctcatgcatggagagtgacagctaagaggtccggggtttcttttgggtggggatgtgaggtgctgggtcattatggacatacggcaatggtctgtctacacaatggtcagataatagtcttcttacagtcatcccaactctagatgctttagccggagttcatcttggggtgggtatgggggattgaccacaacgtgtttttggtcaagagtcgggtagatggtgcatattttggttctgccacccctgggaccttgggcattgctgtactcacccaagctatgtctcggcacaaacagcctcatctcctgagctgtagagtcatttctgtaagtggcttgatgagatagggtcttttagatccatgtccttggcatttattcagaattaactcacataatatgatgctaatctgcattctggctggagctgcatataggtagcctcttttcattgttggcctttatagccaacttaagctcagagatgtgaatcaagggtggcctgcctgatgaattagtgcttataaggtaaacccttatttgttgtgttggaaagtttattgactctagccagaaaaggtctaattagccactgggccctttcctggcagggaggatgtagggaagaccctctgcagctcaagactggacaggtgacctagacctattgggtatttatttcattagaggatcaatagagcagagatttgttctccccaggtctccatcatctgttcataaaccctcctgacccatgttgagtccacagctgtctccactgggctgtcaagctgctgaggccaattcctctgagtccctaggactttgagttttgctctctgctgccccagtcattctcaggcccatggtccttgcagctgggctcttggccaacatcctgagcccttatctcttttccacatattccctgtgaattagtaaacttgataaattctatttgtaggaatctgctgcttgggtcggccacatttttagcgtgtagttgaattaataatatatagtgcttactgtgtgccagccactgctctaaatgttgcaaatatttactgctgtatttctcacaatgacccttttacataggtactattatcatccccattttacagatgggcaaatttagtcacagagaagttaagtgaaacttgccaatgtcatacaaccagtaagtgatagaggcaggattcgaatttagatattctggcttcagtctgtgctcttagccactgcactatattctcttgaatcattataaaatagatatactaatctcagggcaaatttcctactatttgtcttggaactaaccatgttaattgttcaaccaatctcatataaagttaagccttaaatttctttcatggaagccttcaaaaatagttatggtccagtctaaaccgttttacctgaatttcattgaatgcaataggacaatcactccttgtttcactctctgtaccttagataatctggtcttatttataccagttaggtacctacttcccatgtttgttcttgttgattatcattggaaatgagcaagaagggtggggatgtgaggtgaatggggtgtgatctttccacgtacatgtcctttgatggcttctgctcctctagctgcagactctccttgcgttctcctttctggacttcgtgttcctgtcattctgtttcatgtacttgctgcctggcatggtgaacttgttgtttgacttcaagggctttgaaatcactcactcttgttccttaagtgtcagctgtttaggtagagcctctgcttccgcatccaacctagtccatatctctctcagctctgcgtcaactactgcttccaagttagccaaagtttatccataaactttgtttttctttttaagtttaatagggtttaattgagcaaagaacgattcgcgaatcaggcggcctctcgaaccagagtaggctaagagactccagcattaaccattaactgtggctgagataacttgactggactcttgctgctgcatgagagaatctgcaaaatgtgtcatctacacacacaactgtcccttagtctcagggtctgtgacccagcttaacctctgttgatgaatataaagtcaagggataacaaaccccctttaccatacatagcattcctaaggtttacattgtcatgagtaaagatcccttgctaatacggtacaaggaatagtgccttcggagtccagacactcagcttctagacctggagcagctgttaactcagggaagcaggtgatctctccatctctgggcctcagcttttccatctataaaatgaggtgattggattaggtggtatctaagaccatttccaactctatcatgccatttttatgaagctggagacaccctcagacctggcccactttatcttcaggtccgccaatcctctccaacttgtggaggagcctatactctgtccttaccatgcacaggttgacgaacagggaagacaagctgccattgagggtggtaatctaatggcagaccacacaccaacaggatcactctggttctgcagctgagttttcacaaaacagtgcctgtcctggcacaacagaagagctccttccacagaaagttattcctatttgctctctcagatacgaatcactgtgggccaccgcgctcctctgtccacctgtggttactcctgcattgaatctgaatcaagacactgctcaggcagtcaaatgttggccttcggggaaacttggcagatgggagccaagtgagctttcactttatgtactttcagtcctctggaaatctggatttcccctgctatcaaaatagacaatgctattgcctaacaaaatatagacttcctgagtgacatccaggtcacggcttgatctctttcctcctgctgtgttcatgcttccacttccgtgcaccatgttaggttcagatgatctactgaccaaaccccagagaaccactcatgagtcttttcaacctttaccttgaattctagggctatcttctatttggggtttgaaaacaccagtgcataataaagtaatgtattaattatagttttttggtaaataaagatagatcgtatgttactagccttgatgtttcacacaatgaagcagagctcatgaattattataacatccctgatcaaggcagttgatctcagttatcagcattaagaataaaggtatggatggaagcttatttgatttgttcttctttcctattatggatattaaccagctgggtaaattatagaatagggtcatggaatgtttagccctcaagcatttatcagaggcttaaaatgttcataaaaggtgggcttggtgaatgccaggacttagcatggttgaaagggtgttttgagtcatggtacatggcaatatggaaataaaacagatatgtcacaagtaggtggtagaaataaactggaagagaattttaacatctaaaatgtgacaaagatttatccttaccagcttctcagtttcctgaaacatttattttcctttgattttagattctgtatttatgttatatatctctttctaaaacattttcttgtttctgttttctttacttcttttacttttttgccacttctgttttttgaaaaatatcatcctaggcatgctctgaaagtcatttgttcggtgttttcctgatagtgatttctggttataggcccataaagtatctgtaggatgtggttaggatagttcctacctcttggtaaaagtctagtagtaacacaggaagggcacagactttggggacaagagacatttaaaactgttactgatcatgacattaccaaaaatcaaaagacaggggccatggctcatgcttcgtaatctctctgtgaatattataaggaaaattctaagccctggtcaactgtgaaatgaacaggtcttcagtggagttaattagcattttccaggtgctttgctgtttacagtgtcctttatttcatgtatcttctcatttgttacaggtcttctttcataccttttccttttctctgagattcagagaccctttggggaggctgaatttcaggtttgttttcattaggaccttacatgaccaaatcccccctcttggggttccaggggtgctccttcattttactctctgatgggtatgccatgaattgtgacatttaagcagtgactttgcaaaattggacgtgtcagtaggaaaaagtactcttcccaccttaaagattgacaggaacatgagatggctgaagctgttctgagcttttttctggcaagagtacataggacaagaaatactctggagagctcaacattgaatcacatcatatcatagtgcatgactagttgccttaatcttgcagttggactcactcaggagaaattgttggcagagggattaagtagcctgacaaaattatattgagaaaaaaacttgcagtctattaatttattagtagtagatatgagggaaagaagagtcatgtaaaaaaaaaaaaaaacaactggacatgaaaccacggagaaatccacaaagactccattacagtttgttatcagcctcttgcccctggccatgactaatggccagtaattgtctgaataagtttttaaccatttggaaatttcttcaggaaaagaaaaatctagtaaagggagaagggtgaccacaagtcaagctgtgaatgaggaagtcctgaaatgtgggctaagtgggtcactgaatttgccgtgtttgattcttcggttgcaccactttgaacttttgaagtttgatcctcccagtggtgtttctgaggtagagaggctaggattagattgcagtgtgagaaatcccacaaacgtgattctactgtaatcttactgttctctctcgctccttgataactgggatcccattaaagggggttcattattgacatctcagaagaaactcattgtgaagtctaaaataaagtgccattcttccctacaccagctctgcctcccatattccccattattttcccagtcacccagagtcacaacctcagagagatccttggctccttccccttctttcagttcttgtagccctgtcacagtgtcccttatatctagtttttcctttccatgcccattgcccctgcctctcattctttcagtctttccttgcatctcagtggacaattgcattaccctgtgctgtcttccctgcctcctctcttctctgagatctgctcttcttatcactgcttgcatgactccatctcattctccccttgcaccagttgcagaaagatcctccgtgtgtggctttccctcctctctagctttcggtcctactacttccttatcttgtgcttctgtcacaccccaaccccccccagctgcatcctgcttcttgaacacgtcctgtgtttttctcataccttaggtgacatggtaccattttcttggaacactccctcccccttgtctgcatgccaaagtcttaatcattcttcagggaccaggtcaaatgccgtgacatccatcaagtcttttctcatctccaaaccagatgtgatctctccctgtgataaatgtcagtaacactttatacctttcttgtaatacttgtaaggctctgccttgcatagtagtcatttgcatatttatcttgttacacttgaaagtaaggactgtattttattctttgtgaccagtaaaataccttgcaccacatagtagggcatctgtccaataaatgcttgtcatatacaataaagcaatggctggggcggcattatctacaggttaacccaataataggtcataatgtatctgcagatagtaggaccataaggatgtgtagataaaccctgaagtaaatgattcgcagagggtcacatggaagggaaacagggagtttgatacctagcactcactgaaaaaagcgtccggatactgctagagtgtgagactagaaggcctgaaatgtaaccatcatacaccaaagagagttgctcccaaacaccagccaactccaccaatagtatataaaggtgcgttgtaaacagtacagtgattcttaaagatattattaaacatcatactgttaatatataacaagattgactaatatgccaatgaaacccgtgactccaggtacctgtgaaatagccagcaagggttctgagccactgatccaagacaggacaaagttaccaactattcttcctaagaaattgtttctcatcatgcaaggggctgtttctgtcttggttttgtggaaggtctaattctgtggcttgaggacatctgcagtagggccagatgtcagagcaggtagtggtcatgcttcatgaagtttttaggagggcacagttacctggttgatgcaaatggaagtaactggaataaatgctattgttgcaggcccaagctcccagtccatcctggctggtcatagttgactaattcatggtggtcaaaaagtgattctcttgtctttgaattttctcttgtattttaggcaaaacagatttgttttttgatactttcataaagctgtctatccatattctgttgtcacttttcaaaatgatcagaaacctaaagaactaccatacttgcctaaaagaagacacttcctgatgcatagcttgaaacaggaattgacttcctaaaggaaagtatttggcacaccaagcctattgttcacagcgctgcaagagaggcatttcaacatacatgggctcttcctaaaaatataacttgctaaaataaaaaattcagggttcattaaggttaatcatctaataaagtaagagaatttcctctaggtgaaaagtttcagtttattttaggggtgtggtgttgttacaactggctaatctccgcaccataatttaatcaggctggatgagaaagagactagaaaggcgtggagccagagcacagtgtagcttctcttcttttcccaggcttatttttttcctctaacatgtaataaatttactcgtaacaacctggcttttattgtgtcattttctagctaactgggagttactgatgtcagttgtcttttagaataacttttccttaaacatttgaagatcgtaagaattggggaactcattcattcatttattcatggagcatttactgctcacctactgtgtgctataggaacatgaagacaagcaaagcactgccctggccctcaacctggtaggggagatgtgtgaatagggccaaaaccacttaaacaagacagtggctataaaggtgtctgtaccagcgagaaggtcagctgccttccttgaagttgagtggccaaaaccactttcaggattgcaggtgggactatgttttggaggcttgatggatttttcagttatttagttcattctttcaaggaatagttattgagagcctcctgggagctgggcagtgttctaggctctggggccactgcagtgagctccagtactaaatccctgccttcatggagcaaagcaggagatcagacagcaaggagagaaatcagtgcaataccagcagacttgaagtagggaaaggaacaaccatgactctgggcacaggggacagtgaggaggccagtgaggtgggagtgagggaaagggggctaagggtaaggccagagaaggaatgtggaagaaggtcctggagggacttgggggctttcttttcctagaacatgctcctaatagccagcccccagacatctgatggcctgttgagctattacaacattttaggttgatgtcttcattttcattcatgtttttccttttattgtccctgatgctgaaaaacaagaggttgagtttgtgagacaaaatgtcttcattgtgtgtgtgatggggataggcatagtctccccatcttgttctgtgctgtctgccgttaaggaggtggggagattacgatcactctcctttcctgtacagtaatctgctgatctctggaacatactaaggaggacatagagtgacaacatctataatccccttaatctctatattcatactgtctaatctccttgagttacactggtaacataagtctatctcttagagttacttttatcattaacagcacaaaaatgtattatttacagggccaaatgcaagctcttgaggcatataaagtggattaataaggttggctcagcgttaagctatgccagagccgagtccaaattttattccggtacagggatgactttctatgtggcctctctggctctggagctaatttggatgctgagtagccccgcaggtatttatatgtagcgtttggtatttttactgggtcctattcttctcccttggatcacctaaaatggttaagaattttctagtgggattaaggttgtgatctctggggaggggtgggacatctgctctcggttatttttgtgttagccgcttccccttaaatgtatgttcacaaatgagccacagccttatcagctggggttgagggaagactggtctaggtgctgctcctgaacttggtctctgagccatggcttcccatagacactcaggtaaaacttcatgctctttatcttatattgagcacagttttgttagggcagtgaatccgtcattgggctaaaagatggtttttgatgaaatgattttagtcttgtctgaatagtaaataaattatagcttgtctctgttttgcctttgcctttcatgctatttcaaagacaaaatattgttcaagtacaatgaacagtttgagtgatttattttaaaaagaagtatataaacatgttaccactatatttttacctttttcaggacatctcatgaaactataagagattgtgggaggaaaggtttttctggttaggaatttttggctttcttttttataagatacaattcttcatcttgacagtgctttacatccaaggtgtttggagaaggtaaatcgaatgtggagctgaaaggaggaacatttgtaactaagaaagtccataatgacctagcacatcttcccttttgctgacaatgttttaaatcttcccgaagtaacagctatgttccttttgatatgctaagtatgttattaattgtttttagcagaaaaaggggcacattttggactccttgggacatgagcattttcttctggttttgtaaccttacaattaaggaagccctttggccatcgacaagaaatctatgaactaggggctgaggggccaaaagcccagttatttgaagccaggagggtggctgtggccctgtggccctctgcctaagtaacggttccctttcttggggctggtaaagtcagacggttagatataaagaaggcacttcatcctgtctcccagctttcagattaagggatgtcattatctatgtttttttttttttttgaaaaatcattttttaaaactcattgcctgtcaatatttaaacaatggaaatactttaggaaatttctctttttggggttttaaatatgctgcaatggaatgccctaccttaatgaattaatatgtaatgtcttccctgttcccaagtgttcaaaagttgtctggtttttttttttttccaaccctcaggagctgtttcacaaacatggtaccaaatgcttgagattgtggttatcagccaagatacacattctctgggtgtaggcaaactagtcagctgtgctagttgtcctgatgaaccttaaatgcatgttacctggtagaataactctcattttgtttactaattaagtgacagaatagtgacagaaagtttaaaagtttaaatagtgacagaaagtttatagcatacccaaccttgggttttaaattgcaccaaattcttatgtcgttcttgtgtatgtaagtctggaggctctaataactgtggctaaatgggaccaattatttataccttttagatgatttttgaattcaggaaattgcattttgtattgcattaggttaatagattcatgaaagcagagaagaatcagtccatgagacagagaagtcctcatagaaaatcagtgttgccctgaaacgggctcagtatgggcaaaatagaagctaggataattggatccaaatccatttttagtgactatccatatactgagaggacatttcaaggacaaaaacaatgtatactcttgacattgaagactttctgtctgcaaaattatgtagattcaatttctttagcctttggcctttcaagtcgaaaaccaggtttggggtgtggagggggatcaggtcacttgccatattacacagccatcgattcccttcaccagctgctgctcagtgggccgcacaagcccgccagtcttttctcagggcagggatggaaaatgagagggtaggatgagaggaaagtaatccaactggattggcttcttaaaatacagaagatttgagtgagagtgaaactgaacattttgtgcttttgatgaccaccaaatgactacctactacttcaccacagctggagaaactaaaaacacatgctcttttgctgccgggtcagaaatgctttttttcccatatgaaagaggggctgtgttgcacgtaatctgtgcaacattatgaaaaatcttcatatacagacaaaatggtactagaattgaatctggactgcaggaagttcagtggcacataatttttcttttaataatctatatcgaaccctcctgacacccgatataatctaaaatggcattagttatacatcagtgacccaaaaaagatttgttttttttctaaatgcagcataccagtgaagttgctaattacattgaatcattctgtacacgttctattttgaagggaaaaaacactttctgatttttgtatgaaattgtatgaaagactacttttcagccgtgactcatgagctccgtctcattgcagctacttaggtatttattcccaaatgtctgacgacacctccaggtgcattagcatgtctattacacaagtgtcctattcattggctaaggctttgctccatctgttgaatgttctgaggaaagcattataccctttctttagaagccagtgtttatatgtggagtcactaatgtactggtaggttggatttagtgaagaacagatctgaaataacctgatttttttccatttgggttgttgttcattgtttacactgtacattacacccttcatggaaaacacatagaaaaatgctacctactcatgatattcacattctccttaaatattcatagtttgagcaactcaggcatgagggagaagatgaacaataggaagaaatacatgagaaaatacatgtaaaaacacaagcaagatttattaaatacaaatcgactgtaatgagaggtttatagtaaaaaagaaaaaagaaaaaaacaaatgttgtaatgttatattacttgtatgtgtacatgattaaattgaaagccaaaacttttaattaagatactgaggtttatttaggcacctctcagcatgttggatgtagttcaagaattttctgaaaaaggaagcttgtttattaagtgaaaatgatgtgtcttttgaagcaggcatagaaagtcaggctacccttttggaataaatgtctaaaattttatcacccagccacatttctaactgtattctaagcttgtaaaactttaatttagttaatttttaattaaattatttaataatgatgctttctgtcttagaaaatcaggggacatttatgtggacctaaggtgtaggttagacttcagcaccttacacgtcatataagatgatttttaaaatcaggaaatagtatgtcatattgcattaggttcataagtccatgaaagcagaggagaataggcccaagaaagaagtccttacagaaaggaaatcagtgtggtcctgaaatagggttggtatggacaaaatagaggctcagataattggatcagaagccactttcagtgactatccacataccaaagttttagaaacttagttgtggtaacatatctccatctgtcaatcaacaggcatatactgagtgattcctgtatacaaagccctggattaggtactggggccccctagtgtatgagcagaactttctgtcatagagaaaccccacttgttagcactagggaatgtatccaagtcactcggcaccaaagtatgttagcagcggggaatctgtgggtctgtagcaacctcatttcttgcctcctcaaggaagaacaaggcagagggagaagccaaggcaacttttagagcaggagtgaaagtttattaaaaacttttagagcaggaggccgggcacggtggctcatgcctgtaatgccagcactttgggaggctgaggcgggtggattacttgaggtcaggagttggagaccagcctggtcaacatgctgaaactctgtctctactaaaaatacaaaaattagccaggcttggtggtgcacgcatgtaatcccagctacttgggaggctgaggcaggagaattgcttgaacctgggaggcggaagttacagtgaacagagattgcaccattgcactgcagcctgggtgacaaagtgagactccgtctcaaaaaataaaataaagtttcagagcaggaatgaaagtaaagtacatttagaagatgaccaagcaggctacttgagagattcaaaaagtgcatggtttgacctttgacctgggcttttatatgttggcatgattcgggtgttatattacttctctcctgattcttcccttggggtgggctgtccgcatgcccagtggcctgccagcacttgggaagtgccgcatgcgtggtgtttactgaagttgtgtgcatgcttactttaagcgatttttcccttagcagtagagcattcccagaggtaggtcttataccagttaaacaccgcaattttgcctcttagtgcacatgcttgagcccaattacccacctcctgagatctcatggggacgtggctgagcatcagtttcaggtgtttctgtctattagggaccgtgtttccttggtgccagctgcaaccaattattattttagcgagagatagtttaacaaccatctgaccttcacctgatggccgcctgacattcctggttgggtggggggccctctcttgccctgctcatgtctaatacctactctggcatccctactatgtacagatgagggctacaccgagacattaaaattagtcaaagagctgcccgagggcaaacatgccctccacaaagacaagtggtaagggaagaagcatggtgatgatgtgtagcaattgtttccttcaatgatggctgacactcccattcccggataacagcaataggtcaaggcagacatatctagaagttctggaagattaaaggccttcacatttcatgtacttagaaatagctaaggggataaaaaattattccctaagaaataaatgcctaagtacatgtaattctgtaaggttgaagagagcccaaaagaagaggtaaaatgctggctgggcatggtggctcatgcctgcaatcccatcaagttgggaggccgaggtgggcagatcacttgaggtcaggagttcaagaccagcctgcccgacatggcgaaaccccgtctctactaaaaatacaaaaattagccaggcgtggtggcattcacctatagtcctagctactcaggaggctaaggtaggagaattgcttgaacccaggaggtggaggttgcagtgagccaggatagcaccactgcacttcagcctgggtgacagagcgagaccctgtctcaacaacaacaaagaggtaaaatgctatcttcatttttccctattctctcatttcaaacaaaagaaagtgcaagctgggatggacgcggtggctcatgcctgtaacccctgtaatctcaggtgcggtggctcacgcctgtaaaatgcactttgggaggccaaggcaggtggatcatgaggtcaggagatcgagaccatcctggccaacatggtgaaaccctgtctctactaaaaatacaaaaattagctgggtgtggtgtcacatgcctgtagttccagctactcgggaggctgaggcaggagaatcacttgaacccaggaggcagaggttacagtgatccaagattgcgccactgcactccagcctggtgacagagcgagactccgtctaaaataaaaaagaaagaaagaaagagcaagcttttctctcctcatgaagtcaaagcttgatagtagctcagactcagggagcccacactcaggatctttgcatgtgtgtctcagcattgtcatttataagctggctttttagagttgttttggtcttgtgcacatcagcacatcattcatattttatacaaaattgtgacgtgatcagtatctcctccaacttcatcctgagcacactgcgtgcatgagggtttgaaattgttttgtaacaaataatcataaatttagaagtacgtgacgtaagctaattcaggttgcccagagttccacttaatttgatttattgcaaaacaaatacgaaagttcatgaatttgacatagacattgttaacatactttaagtatttctagcctgtttacttattatgcaacaaatccaacattcctagaagtgcctattttatctagactaattgtttccacacacattaaaaggactcaagtgaattgtagaaatgtattctaaaagaatatgccctttgaaatgattctccatctggatacagactgcaggtttaagtatagagtggtggggaatctaaggtgtaaggtgaccctagagttttcaaactcagagtgaaaaaatcttgcctaaagctaggattcaaaaataccaagagatgaaactcttcttatgggtactattaacttggggttgattcatttaattttccttttgcttggtttaagaccatgtactataggaatgatacagtggccagtgacttcattgtctgacattttcaacaccctttgttacttctatcttcactggtgagctgtggattattttatcatctggatgcttagaactctgagcaagtcatgttctagaactatgagactaaacaatgaagaactttgcactggtaatatcaaagtactgaaagtgtgtggttttaaagtgtgaaaaacatggcagttaagatctctcaggtactttgaaccataatgcagttttccttctcttcaaaacctctacttctaaatggcattcattgtgttttctagtgttttttctttggtatgacactagttaacctgtatttcttaccataaagctaggactcaaatactaagaggtttgactcaccttaggtggaactttatatagtactttaacttagaaatatttggaatcaatttctgcttataaaggtatcaaaagcaagtgatactaaaacgagtaggttcaaagttgtatactaaatagagaccttggtaagagagaatgagggattttcaaatatggtccagaagatagtctctgaaaggctaaaccagcaatggttactagccatgcaggaagccagtgctgtctaatcttacaaattctgttttcctgccaaatggcatttaggagcaactgataatttatttcttgccacttgccgttactggagatttatttggtttctcaactcagcccttaacaagaaagcaagtctttgttgagggcacaatattatcagtatggcaaagctaagacgaggcttctgtgtgacactggaaagaccaacaagaatggattaaagagagtgattttccatatgctgtcactgggacaggtacttttctctgtagacacacaggctaaaagcagtttaaaagcttccttacctaaacagtacatagttcaaggagataggccctgtgtccattgcgtctctagtttttgtttctaacccattatataaagaaacatcccagtttgctttttagagaaaagttcaagttagaaccattctctggtcttgctaagtctcttaattgtgacacaactgtcctaagcaactgtccttgcacaagaatgtcactcatctgcttcatctgccagctccttagagatgaggggggtctgtgtgtcagcaggaggcagaaggccctgtggctcatccagtggcctgatttcctttgtttggaggcttggttctgagtgagagttcaacagcctttgcccaggcggcttctcaaacacagggtgtggtttccttagctcactctctgctgtttggttgctcatggcaacaagatccaaataacttggacatgtgtttgtataaaaaaaacctgggaatggaacccaaagtgagactttggggctttcagttagtggaagagctgcggtgagtaccaggcaactgctcatttattttctctcattctttctctctaaattacgctggaagtttgctagcacaataaccatgtttgtggatagttttagaaagtagtctcaattcttgtatttcctgcacaaatgaaataattgctatctatttacccgtgcaaatttctttttcgggggagaggaacaaattagcatatgtttaaagaagttgaaagctaatagaaactcatatttggtaccttttgggtggcaggattctataggaaatgccttggcaaagggagctgcagagtgccttagtaatgcttgggattgcaggcgtgttgtctagggccacagccggggaggggaccagggagggaagaggggttgttcatacggagggagtggaagggattcttggaataattttttccagactctattttaagattataatttttaagacagcaaatatcccaaatggtaatactggttacacttctatgagcatattgattctcacttgcttgactcaagggagggtttgattttggtcacaaagccacccgtgactatgacagataattcaaggttgccaaacttgcctgtgccaattgacaaagccatttatataagtcctctcttgctatattgctctggcctcaaaaggcagtaaactctcttggacaaaactctttaggatctattcagggatttaacacttttctgctaaattgcaagtaaatttaaacattttaaacaaattaacaaggattgcttaggtacctggtgtggtacagaatgagctgtcagtttctattctgatgaatagaattttatagataggaggaacgggaggcctccagaggatactaccctccctaaaaagagacggaggaagagctgaaagcgggcagagaggcttcttgatgacaacgtggtgggcttagagaagctgctgcctgcaggcggggcccctgctttcctgcacccctttgagcctctgccccacactcttcctttgtataaaacaactgcttcttgcctgcctgccccatcacacccctccactccatcgggtcactgctcaatggcacaatagcactgctcagccatacctcccagcatcctgtcccctatctggtgacttggccaacacaggctctgatccacttgccccgctccgcatcttttgtgaatcagcacagttgatatatctgagcaggggcttctaccatctccccagggaatcactagccatcggccatctggccccgcggggtgcttttgttcctggaatcatagtgaagtatctgttgtcttggtgcctggtagtcagctcggctgaaggggaagctgggtcttggtcctcagaccccatggactccaaggcagcattgtgcaggtgcctctgggagccactgctcagggtgctggggcatttcctgtggtcatttgtcctgtctgcttgcccccgcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggtaacgggcatccccatgtgccaatgggaagggctgggttttggagtgtcctttgcccacaaccatggcagcagcagctggctgttaggatttcccagcatcactgcagccaccttgaggcctcaaggaagcctcctccactccccaggccacagtggcccgagctgtttaatgtggggcttgactggatgggcgccagcgcccttgccagctcttttgattgcattctaaatatttcaagaattgtgagatttttatcctcacctcagcgtccctcctataagaatagtcactgtggggcagtcccaggtgtaagggactgtgtcatctcagtggtcagtcccagggaaatcagccttatgggagggctcctgccaccacccccagcacccctcatggtggcccaccctgtctgcttggtttccaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggtactgcctccttcccaccccgggttcccagggaggaggccctgagggcagacgtgatgtgggcttgcttatcatggtggggctaacgttgctctgagctgctttgagatcttagcatatatatgtacacatatacatacacgtatatatgcgtacacatatatgctcgcacacacgcacacactcggagactaaagaacactggcgagaacagcctgtggcaacagaatgaagtgaacagtatgtagcgctttctcatttgggcgtagtaagtgatgaaagcatgcttcttcctcagggtgtcattctgggccaggcagtccctgatttaatgtctaagtgcacgcagggtatagaggtgggggagtgggggattcaggcactggatcctaaaataataatgctggggtccccacccatgacagaaatcctgggttggcacaagcacaagtagaacacaggtaggttagttggaggtgtgaggccagtaactgcagggcctgcatcccctcacctctggagggcctggggaggggagctgagtggatgcagccccctgcagagcctgtcagtggggctatccaattgcttccctctgcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggtatgctttcaagggagttctgcattgaccgttgtttctagaagtgtttgacagtttgcagagcacttccacacacactatcccattccatcctcacgacagccctgtgacgtaggaattattattcccgttttacagatgaggagatcgtggattaggaagcagtgccacagccaagtcaggctgtcagtacgcatcctcagcctggtggtgcgggtggcccgtatggcatgctgagctgggcagccctggctctagaagcctgcctccaccacttaggggctgtgtaacctcacataggggctcaccttctccgagccttggtgtcttcatctgtaaagtggggataataatagcccctgcctcccatggctgttgtggagattaaatgagatattgtataccaaagcgcccagcacagtgcctggcacgcagtaggcattcaacaaaatggttgttgaatctgaatccggtgctacactccctggtctaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactggtaggctaaagagtcc

SEQ ID NO: 1006 - DNA, 61153 bp, mus musculus
tacatccaccgcccggcggagggggctcagtccgcagccgccgccgccaccgccgcgcctcggcctcggtgcaggcagcggccgccgccgccgagacagctgcgcgggcgagcatccccacgcagtaagcccgctttctttccgcttgtgcgcgcgtgtgtgcctcccgcccgccggcgtcctgggtcccgggggagcggctgcccttctgccccgccgccgccgccgctcggggctggtccctgcggtcccggctgcctggccttccagggctgggtactgcggcttcggcggcctcgctgaggccgggggccaggggccgtcccgggctgcggggtgcgggacgagggactgcgagtgcgaggtcccccctggtgcgtgcctcggccttccctgggtttttggctcgatggggactaagaggcagtggggtggaggtgggggggatcgggagtgaaatgggggctctccatgttttcctgtgcgggggatggtggggagtgaggagggagtgaagggggggccctggttttgtcaccaaggatggcgggcagtggggggtggggcgaggtggggacacctcttggttctttcagccaggatagctagcaggggctgtggggagcgggtgaggatgaagcggtgggtcgactcccttggttttcccatcaaggatggcggggatcgtggaggggggagatgggagacctgccttgcttcgctcaacgaggatggcgggggtggcgacgaggagtagacgtgagggggcccgcctcggttttcttgactgggatgcttgtggggtggttggaggatgggggtggggtgcagaataaggagggagggggagggcccgctgtggttcttctgtccaagggggatggcgcgggtttggcgaatgggggtggggagggggtatttcagctccagcgtggaatctagagaagcacgaggaaggttctatcacgggggttgagccttagaaggtgggttttcaaaactgcagggcgtgacctctcccgcctcgaaaaacgtgaaatccttacaaggtgccgtctgttctaggctctgggacagaggtttctgctttcgaagtttctcttcctttcctctctgctcttagcgtccaggactaggtaaaggttaaaaaatcatcaaggctaagcgactgttgtgtcgttcgtgttgagcgctgtattattttctgcatttgggaatgtgcgagtttctcaggtttgttttgattgccttttacaataaaaaccccatactagggagatcccttaggaaaagaaaaggacaaggcttattaatgggatgccaggtttggattttgaatttcctgaagggcaggagatacatccttgtagcatttcgcttggttttgagaagagtagaagtagtagaataagcgtatgtatttgctggaagtccccttgtattcatttaaattatcccttcgggattatccgagccccctttgatttgggtttggaatagatccagttttcctaattggagccatcatcttgtaattgcttgtaattcttctctgggttatcaagtctatggcaagcttatagaacagcaggaataattttttccgtcatcttaagacagttttaatgtaaacgttacggtgttccttgcaaatgtgaacatttgcagaatagcacaagtttaaattatgggcccccctggaattttgtaaagcctttcctgcctcagctcatctccaagaaccgggccctcccgatccttacactgaagaagcaagagcttctgggatggtagctttgcctttacaaactcatgttcatgtttgcttaagaagaatacgtattaagcaggcatttgccttttatgtggtgagactatagtgttttcccatttttggttacataaggttccgatcaagtctttaccttcagtctttaaaaatgcttatttaacatttttaagggcaaatataatctttatgcaacaggaaattggtcagataggccatgatttgtgcaaaccacctcacgataagtacatagtctaagactatcatatagattctgtaaccatatatggtttttgaaattctaggctaccattcccatatttaattttcagaaaaggaaaatatttttttcagccaagtctagatttttgagtgaaactaagaaaaattgtgtaagatttaaattgataaaattcctcctgtataataccagtgcattggaggtaatttaatatatattaaatgaatcgaccgctaaaacaaaataattattttttttcctggaagtgttaaactggaaatgtttaaggggaaatagatttttagtcacaaagaccgacaaaaatgcatttatttacactattgtattataatgttagtatggtattcattctgtgcccccaaatagcaattgaaaaaatagcatatttttataataaaatttaagcataatgtttttttctctgaggagtagaatgcagaaagtggtaaaaaatcttttacagagagaagcatgttgataggaagtgggctttaagtttctctctggacagaaggtgtaaatggcgtatcttttacctggctttttgagaatctgttgccctctaggacatgaaagacatttcaggaattaacagaagtcggatcaaattctcttgctagatgttcttaaagattttgctgatacgcatttgaaaatttgtaaatcacgttttcatgtaagaaattaaccctcacctctaaagtttgagcattaaaaaagtttgttgaaggcatggaaggtaatctcctgtgactgaaccctgttttcccactctccacctcctagttcccttcttccccatgcctctcctttctcccccgtccggtgccagcaacattggcttttataaccttatgggagttgaaccaaatattcctgcttgctcgaacttgaggccttatctttttggctgctttccccagcttttgcctactgaacttttttttgttaattgaactatctagttgtttggatttggggtaaaagggagtagactgtaattgttttttcttaaaagatcttttcttttagctcctgtgggacaagagcagagaaaggttcttttttggtcagtggtgtacttaattaagcagaatatatgacttttcgtttattcaacaaacatttgccgagttacctcctctgttggaggctccatgctaggtgtggagttatttggttgataagaaatggcttccacctttctggtgaagttatgaaaatgaaaaatagacagtgaatctgttgtgagtaatcaagaattgtctggagttttttggacagacaaaaaagatttcttgatgtttacattcagctttgtattactgtatagagtagggagaagtggatggccagcatcccttcctgcgacttaatgcatctctgatggcaaattgggcctccccaaaatatttttctggggtcaactttgaattatggatagtaatggatgatggagcccagaagagtggatagtcctaaatagtagctcgaataaacctttgaccttctacagggttgcttcctgagtgcctggagaaatcccctctttgtggatagtgccacactggtggttttcagccagggcgcttttgccccccggggtcactcaacaatttttgctagatgcactccactggcatccagttggtagagacagggatgctgcttaaatatccaacagcgcatagggcagtgcctggcggcaaacaaaattatccagcctgaaatgtcgatatgccgaggttgatgtaatttcctctacataatgtagcagaacataattccaggagagtagagaacaataacagcgtcttgaggtgactgagtagttggcggagctcactttattcgtctcaaaaatgactagtttcagccaggtgctgtggttcacgcctgtaatcccagtactttgggaggctgaggcaagcggatcacttgagcccaggagttcgagaccagtctggccaacatggcaaaatcctgtctctactaaaaatacaaagaattagccgggtgtggtggtgtgcgcctgtagtcccagctacttgggaggctgaggcacgagaatcgcttggacccaggaggcggaggttgctgtgagctgagattgcaccactgcactccagcctgggcgacagagtgagaccctgtctcaaaaacataaaataaataaataaaagtgactagttcctgcataccaacctgaagaattaaagaaaataacagctaccatttatggcacttactctgtgccagaggacttgtatacattatatattctcttcattttataaatgaggaaccacactcagagaggtagaagatcttgcctggagcctcacagctggtcaaggttagaagtagaaatcaagattaagattattactccttttaagttcatggttttaagcacaactatgcattatctcccttgcggcatgcatcattcaaaatcttatgtaacaaaatgaaaattactatatgtcctatataccattgggcttgcctgagagtaattaaaaccatgaatgctaaatgtgatcatacttggagtaagtgacaaggagtaggggaaaagggaaccaacattaattgaacacctactaaaatttcaggaagcacgcaaattaaatatatactcattgtctaatttgattctcagagcaactctgcagttatgatgcacattttacagatgagagtgggagatatttgttaagtaacttgtctaagattgcacaactaataagcagcaaggttgggatttgagatgatgtcccacaaccaagccactctttgctgcttactctaaaggtaggaagtaagttgagcctcttggagaaaggaaggtaactggctctgggtaaaaagtaacttcaggcagagcgcagtggcttacgcctgtaatcccagcactttgggaggccaagccgggcagatcacctgaggtcaggagttcaagaccagcctggccaacatggtgaaaccccgtcatggctaaaacacaaaaattagccaggcgtggtagtgggtgcctgtaatcccagctactcgggaggctgaggcaggaagaattgcttgaatccaggagtcggaggttgcagtgagccgagatagcgccactgtattccagcctgggcgacagagctagactccatctcaaaaaaaaaaaaaaaaaaaaaagtaatttgagaggtaacacgtagtagacgttggattatattcaggtagagaatggagagatgaattgctataccttcctcatctgataagaatcgaattctacctggaatttgttctagagatctactcaaattgaaacagtgattgtcattttgtcaaacttcattttctatctcacctgaattttccaagctgtgctttgataaccatgaacctggaagttatggaaatctgtgcttaacctttcggtagctcaccttccacctttcttagggctgtcctgtagaacttaggagtgacaacatttggtttttgtcttctttttacacaatttaaacatttgtgcttgctatggaaattgtttttataatacgcggcatcaaattcattcttgtgtttttcatatggggttgttttgttttgacaactaaatatttactttaagttttaacgtgttttgtttcggagcacaaaaagaggaaacatttaaaaaacagcccaatcacaatcattttgtctgaaaagcatttttttgcgggaggtgggggggggcaggaaaaggaccacatgtttaatttcatttgcttcaattggaaaggaattttaaccacgattctcaagggccaggatgctggaaaaaaatgttatttagataaaatgcctgttttgatatccacatagaactgtgagccatagattctgattataataataatgtcctgattctactacagcaatcagccacttgagtaatcaaccactgtgtatagacagacatgcatggtggtaccatctgatttgtcccatcacccattgattcattctagagtagacttgagagatctgatagaacttgcaagaatgaatgatccttttgaaaatcaaatttttcaataagaatggtacattttattgtaggaaaatgcagaaaatatagaaaagcttcaagaagaaaaccaaaatcagtcataatccaccaccccaaaattaatgacaatattttgtatgtcctttaaaaatggagtactttctaaaaatggtggattcaagcccattgcaaaacctccaacttatatagtgtgttatttttttttaaatgactagattttctgaacgactgctacatctctagatggaagtcatggtcataacccatgaaaagggaaagctgacaggtagttggagaactatgctatagcctcttcctggcagctatgtaaagaagcttaagggtagctccttcaaatttctcctcttccagcttgaatgatcaagtttcaatgctaaaagaggctgttagtacccaccccccattattttacagatgaggaaactgaggctcaaaggggtcaagcacctaatgtgctaacgtcagagttccagcttgaatttttagattgtcttcataggtaggtaaattttttatttcctaaagattcttcacagtcaaaaactttttcatggcctgaccctcaaaagaacaagctattgtggtgggagtatactataaaggatactaaaaggccaagtataataacttgctaatttcagaatatgttccgaacagctgtgggcagtacaggaatttttcatgttatttgctttattgtaattgaacatttagtgatggggaacctcttggatgggtctagctctcagtttaattttctctagcctatgaggcaagtgccaaggcatatgaagtatgcctataggtacaaaaatgaaagatgacattgaaagagtctttagacatggtagcctggaagatcgcaattagggcttttgctccatgaaagtatttttttcctttataaagggagatatctgttgaaattgtgggatagagattttaaagattgcatctgcttccaaactaaggtcaaaagttaaattgtagtaaatgtgtgcagtgtggtatcattaaactgtacacacatacgtgaaattgttgttttaatctggcatcttttttttttttttgagatggagtctccctgtgtcgcccaggctggagtgcagtggcgctctctcagctcactgcaacctccgcctcctagcatcaaccgattctcttgcctcagcctccctactagctgggattacaggcacgtgacaccacatcttgctaatgtttgtatttttagtagagacggggtttcaccatgttggccaggctggtctcaaactcctgacctcaggtgatccactcacctcggcctcccaaagtgctgggattacaggcgtgagccaccacgcccggccttaatctggcattcttaaaaaaatcagttatttagctttcttccccctcttctcctgccccatttcatttctttctgtagctgtgagggtcattctctctttgtatctgtttcactctcagggtgactcttttttcagtccacctgactgcactcactttcctttttccaggctctccgtggatccatatccttctatcacattcatctgccactgcatcttgcccttgtccccgtttgccagtgttaacaattaccccaccctgggctgggccagggctgtttttcagcttaggccgggcagggaagctgatctccagggcagatgtggagtgagaagagttgttgtcactctatacagaaatgtcattgacagaataggattaaacaaaatatgtacagagattacataggctatgtatacatgtaaacttgtgaacacaaaatcattccttctttacagctagggtcccagcaaatgctacagctacatgaaataatgagtatggatacctattgccgagggcttactatttgaacaagtgagagaattgtactcttgcctaggggtgtatttttaagtagtttttgctcctgttccttattattgcctgctaatggatacgtatattgtcagtaagtgaccaactctcctagcttcctgtagtacactgtatttctcttctgaaaatggattttcctctgtatttaaaccacagatttacttgtgcctcatttttgaactactatagataaaaactcacagataggaaatacctgtggactgtttgaaatgcagtgaaacctagaaaaaaaaaaacaatcaaaataataagtatctcctgtcggcattttactgcttgtagaattgatattctatttgcccacataaaatctctctggatgttattcctattgcaagacatagtagcttttcttcctgttccttattattgcctgctaatggatatgtacattgtcagtaagtgaccggctctccacagcttcctatagtacactatttctcttctgaaaatggattcctctgtatttaaactactgagatttatttgtgcctcatttttgaactactatagataaaaaaggcacagataggaaatacctgtggactgtttttgaaatgcattgaaacctagaaaaagaaaataacaatcaaaataataaatatctcttgtaagcattttactgtttctttttacccacataaaaactgtctggatgttattcctgttgcaagacattaaatgttctatagccttttttttttttttttgagacggagtttcgctcttgttgcccaggctggagtgcaatggtacaatcatggctcactacaacctctgcctccgggttcaagcgattctcctgcctcagcctcccaagtagctgggactacaggcacccaccaccatgcccagctaatttttgtatttttggtagtgacggggtttcactgtgttggtcaggctgatctcgaactcctgacatcaggtgatccgccctcctcggcctcccaaattgctgggattgcaggcgtgagctgttctgtagactttctaataacaagaatttgtaacagtcacaaggttttaaatttccttttcagtactaaggaaatgatagctgggaatgcaaaggctttattggcaagattgttttgacaaggatggcacaaaactaaatttctatacttgattaatttataagtcttgtcactcacttttagttttagagtgtggataaagctgtttgattcttgtcagatttgaaatgtatgatttatgagacattaaggattggtttttcagtgcactctgccaggtctagttttatgcgtcattctggtttgggaagctgagtgcaagtctgcctacagacataatcaatcacctgcactttcgggtggccaggtggactgaagtaacaggtttccccccaggtttctcagagactaaggaatacacacacacacacacacacacacacacacataggcagacctgcaaattatcggtccaaaaatatttatatcactaagccagagcagtggatttagacatttgacttaacaaaatttgtttttcaacacgttctagcaactaccctgtaaatgatcgtcatttcacctacaacaatgaaaagataaagtcctcagccgcatagcttctagaggctaaagaggcacgttaagttgcttgtcaaagactccacaccttcagatgccagggtcaacacaagttttcaaaccctagacccaatcccttctaggccacagaaggtctgcctcttgtaaggaaggaattttccaatgcactaagcacagctaatcacactaaggaaagaaaccaagcagccaaactaatatgaggaagtgaaagtttatacttgcatcttatagcagatggcctttgttagagccacttttaaaatatcaacttcaccgagcatgatttaggtacaaaaaccggcatccaattaaagcctccaatttgatgagtttagacagatgtatatacccatgaaaccactgccccaatcaggatgtggaatgtttttatcacctccacaagtttatccttgccccttttccagtaacattcttcccccagcccctttcccccagatatcccgttatgcttttgtgtgagagccactttcaaaactcagatttgaaagtttgtggatcttcctctataaaaagactatatttatgtccaaaatgcaattgtcttctctatgtttaaaataatactacagagaaattctaggtattgatttcctagaatctttccctcatcctctgcaagtaagctacttagtaaatagtttcattatgtacttgaattgaagagaaattacagccaagagaaaaacaattctgatagacagaaaagcagtgtatgttcttctcaagtagttacagtgaggtgttaaatccctcaagaaccagagaagtaaaatttgaattttgcttcgtacttatttgtaaagtaaaaatgaagactgagaataaaggttttatatgtatctatctgtctaatcattcatccatccacccatccctccagctagtgtgtgtatatatgtttctgtataaaattactatgtattaataaccctatcccttgaggattacaaaagatttgaaggcttcagagggaattttctgtgcatgaaaggtgtactgtctttacacacttaggtgcaaagcaagcttttcatatgctgttattactctcattgatatatttaattgaactaataattattgagcaatttaaaggctgctgcattgagatggagtttgtcccttcgtttgtcaccttctagaaaaatccaagtgtcaaaaaatatctcgctggctctctgttctgttgctattacttcggcatgcgtcgtctcctcttgccactctcgatttctactgtttctgccctatcttccttccctgattttcctcctccatgtctttcccgtatcctgatgccacttctcttgcactgctctgatttctcatgagaaagccatttttataaacatctccagaccgagagggcagcagactaattccaatgtgtcagatagcatcttggaggctgtttctcctgtgatccaacacttttttcacactcctttccagtttcgagctgtactggaaattggagagttgtgaaaggatggtttttggataatcaaagttgaatatacttgctgggctgtgttatgaccgtctttgaagccacgaatcattaaaaataagtgaatagtttacattataatattcctaggaaacttcctttgataattgtaaagcaattaaaattgtcctgagataaggtgatttattgtttttcagaatgggccataaagatattaaagaacccattcaacatttgtcaaaacccataaaatgcacaacgcaatgaatgaaccctaatgtaaaccctagactttagttcattataatgtattaacgttggcccatcaattgggacaaatgtaccacatcaatacaagatattaataataggggaaactgggagatggatgctaaggaggtatacagaaactcagtacttcctgcttagtttttctgtaaacctaaaactgctaaaaaaaaaaaaagtctactaattaaaaaaaaaaactcttcaaatgtatgggtttcagaaatacaaagactagatcaggagctttttattattaccgtgtggattaaagtctactgtttgtggccaggtacagtggctcatgcctgtaatcccagcaatctgggaggctgaggtgggtggatcacttaaggccaggagtttgagaccagcctggccaacatgatgaaaccctgtctctactgaaaatacaaaaattagccgggtgtggtggcatgtgcctgtattcccagctattcgggtggttgaggtgggagaatcacttaaacgcgggaggcagaggttgcggtgaaccgagatcacgccactgtactccaacctgggagacagagtgagaccctgtcttaaataaatacataaataaataaataaattccagtgtttgtttttcagaatgagtgaaataagagatgtgtttctccttgagtgatgtaacttgtggcacgagcccctgaaaaggggaagtatgaggttccaggagagctgcccagtacctccaatgctatgtctagttgcacaatagtcagtagataggtcagtgggagcagtgggttgggacttcgcttgccacccttgaaacatcatgccatctttgcagtggagtcccagatttggcaaattccctgccctacaacccagtgggccctcttttgacccttgcatttgtggtatcattagcaacagtgacagttggtgaacttatgccaactctgagccaatatccaggtcagagtttgattgctttgggccaaaggctattattgcatggcttgtagaagcataggcccaatgccagaacttccatgcacttactcagtatggccagctctacagtaaacgtgtgtgaaaagattcggtttttataggcattaatgtaaatagtttctttatattggacctgggtaactatgatgggcaattacaagtacccattgctttcctgagttggctatgagaacagaacattctgtggtacgtggtagtgggggtgaggggaggatcaggtctaagagggacattgcagctgcaaagggaaagaaaaaaactgagaagccatcaaggattagaaggcaaatgggagccatcactcaagcactgtgtatcttgaagtggttgtctgtcaggtctgtgataagacctggggtgaaaaacctcatagttcatgtgattatctgaaaaataccaataaagggaagagttgattatagagttcgcctgtttagtttttttgtttgtttgtttgttttttttgaaactgtgtcttgctctgtcacacaggctggaaaacagtgacgatcgtggctcactgcagtcttgacctcctgggcgcaaacaatccctctgcttcagcctcctgagtagctgggactgcaggtgtgcatcaccacacccatctaatgttttagtttcgtagaggcagggtctcgctatattgtccaggctggtctcaaactcatggcttgtttagcttattaaactttattttgtatattggaaataattctttgtgtacagatctgttaggtgtcctcattgttacatctattgttagacagaattttatttttcttaatttcattggttgcctgaattgactatatatgtggtaccacctgttaaaagcagattttgatgaggaaggggagaaagaggataaaaataacctctccctcaagtcccatttcatgatggaagctaggattccagttcagtggccaggctaaatggtcacttgatgccagtagtgagctactgccactggatttctttcagtcagcttcacaatcgacaccaaatcctgcagctgacgtgactttactgcaattcatgttgattggaaaaatggcaaaagtcaccatctaacccaatcataatatgtttgtttcccagatatagacaggctgggttcgtcattaggcctagtgtagtcatgctccctaactactgtgagtatctggaaggattggggaggtatagtggcagcggcttgtgggacaggcatgtgacagcatccttttgcccccttgctgctcacccacctgcttcttgccacctattggctcctctttgtcttcccctcattctgtcttctctttatccttaatccagttacttttgaattttctgttaaggaaccaggagagcctcagcatgaaaataattggcttaagtattcaaagtaccagagcaacatactttataattcttggactgcctgattgttactgctgcagtggtttgttgggtattaaatgagacttagggtattttgtaaacgttttctgacatacaatttgaaagttgaattttgtcaccttacaaacttagttattcctgcaacttttaaaacccccctaaattttccttatgtgttcatgattatccccatagcagataatggccacatgcgtgctgatatgaaggatttgctccagggctaattgatgggagcagagctgcccagttgctgaattgtaaggaaacagttcatggagcgccaatgccaatttaggaaaagtatggggctgagtacttagtaagatgaaataaaaaaatatttatccagtgcttactctaaggagaaggcacttggctaggtttgctagatgctgtggggagccttaaaacaacagtgatctcttcaaggccgggcgtggtggctcatgcctgtaatcccagcactttgggaggccgaggcaggcggatcacttgaggtcaggagtttgagaccagcatggacaatatggtgaaaccccgtttctactaaaaatacaaacattagctgggtgtggtggcatctgcctgtggtcccagctactcaggaggctgaggcaggaggatcacttgaacctgggatatggaggtggcagtgagatgagattgtgccactccactccagcctgggcgacagagagagaccctgtctcaaaaaaaaaaaaaaaaaaaaagtactagcgatctcttcaagcaaagaacgcccattctaattggagaagctgttaaagacacatgaaggatgtggtggaaagagtattgaactgcatagggtgtggggagagagtcaggagttttgaatcctagcctgagttctgccactaagcattggaaactctgggcaaatcatctccccactctgggtctcagtttataaaaaggcaaatgaacgagatcatctctaagatattctgtagattgattcataaatgtggaagagattctggaaaacggaagcttgagcccaggagttccagaccagcctgggcaacatggtgagactctgtctctacaaaaaatacaaaacattagcctggtgaggtgatgtgtgtttgtagtccctgtttctcaggaggctgaggtgggaggatcacatgggcccaggaggctgcagtgagctatcacctgggagcttgttagaaatgcaactttcatgggccccactccagacctagggaatcagaaacgctggggatggggccccgccatctgtgtcctaacaaggtcctctctcaggagattttgaggcacaataaagtctgacaattacaggctataggaatttgggtcagtggttctcagcctctgccatacaatagattcatctgggggaactttgttgggggtggggcgctgactttgtttgtgctgctgtaacagaatatctgagactggataccttataaagaacagaaatctatttctcacggttctggagactgggaagtcccaagatcaaggtgcaaacaggttcgattgttaagggctgctctctgcttccaagatgacactttagttctccagcctccagaggggaggaacgccctgccctcatgtggcggaaggcagaagggcaagagagccaaaggctctgttgaagctttaatcccatccaccagggaggagctctcccggtttaatcaccccacctcttagaggccccacctctcaataccatcacattgtccattaagattcaacacctgaatcttggacacatgaaaaccgtagcaggcacccaggcatcactagttgctttggctctccaggtgccgccaattttgagaatcactggtttaggggaaagtggcatgaaccaagacttctgtcattctctagctgcaatgaacgtcagatgcagggagtcagccaaagccagaggcttgaatttcactcaaagaaacttggcctttagattacaatggagaaaggtttttggcaatgggagtgatacatccgaggtggaacatttgagagatgattctgatgctagctatgtgaagaagagggcatacccatagttaagaaatctgatgaaatagtctggtgtgaagtgataatgggccaaattaggaccttagaaatgaaattataaggaagaaaatgtatgaaagctcttttgcaggaaaaatgggcagggtttggcgatggttgctggggtgacagcaatgttagaatgtctttggttcaggagtacctctcagacttctgggagggccagtgctctctagatgcatctggcaaaattgtcatgtatggatctgtacaattctttgttttttgttgctttgatttaggagttataatgcggaggtgacccacagcaagttatagaaaaatacagaattacagtcacctcaaaagctactcatggtcatcatgtcagagggaaaaaatgctgtttttcttttaaggaaagaatgcttggagttgtgggaaagttgtagacttggcaatgagtaattcaagcctatcagtcaattaagtgagtttttattttatcatttgttttatttgggagctgctgtaatagtcattgagaggacatcagtcttcatatttttaaaacaaaacaaaaataccattgaacattagggcaaaggacaagaatttcaaggtttttaccttttgacttcagcaaatatttgctgctccatttttcttgctagattttgccatttgacttgtgtttttcctttgttccaatttgttctttgtgcttgataactgtagtgtactctatttttttttttttgagacacagtcttgctcttttgcccaggttggagtacagtggtgcaatctcggctcactgcaacctctgcctcctggattcaagtgattctcgtgtctcggcctcccaagtagctggaattacaggcacgcaccaccatgtctggctcatttttgtattttcagtagagatggggcttcaccatgttggccaggctggtctcgacctcccaaagtgctgggattacaggcgtgcatcactgctccttgcctctattctattttcgatggcttttttattcataagtattcttaaggttttaatattccagttaaaaaataaatatatttgtccctttatgtttttccccaatatacttattcttcctttatgaccaaaaattattcaaatttgcatccagaaatggctcacagaaagagctccttggtatttatttagggcatggtgggaccttttgttagtttctaggtcatgccacatctggaaggaaagacaccttttatttactaatttgaaaatctatgaaagcagactcagtattttacagggttgcatatattcctatgcaaagttgcatatattcctatgcaaagttaaaaatgactcactactccaactttggtaaatgtgtgcactttagtttttgaaagaagtgcaaaaatctgcagaaaaatctggactaatcataacttgaaatttttagtatatctggtagataacttttaaaaatataacccatcttttcccaaactggatagggataattcctctctttgcaaattgtgaggaatattatgattgtatcatataaaataaatatagaaacgtgtagaataaatgatcttccagagtatatagaggatatcaccagataatactctgtactaaatataaggacacaaaactggactttattatatttctataactggtaatatccttccagtttttgcttgtttattaaatgaatatactgttaaagatttggttatgttgtagatcttaattatgttggaattattaaaaatgaggcatctttaatctgtactgcttatttccaataaattattttgccgaatgagagccagtttaccagttcttttgttaaagaaaatgagccagtggctacctcagttgtatttatcattgccttttatggtaaacatttaaaatgtgtttttaatggtgcacatgccgatgtttctgacctctatagtagcataagtatttgaataaaagtgaggtaaatgagaagtctgtgccacccagtctcatcacaagtgtacctaattaagaagatgtttggaattcactgttctttgatttcttgggtgggagagaatattctgaaggctgtgattaaggaatcgttaccatgacaatcacattcaaagaattgagaggagacaatgagtctgtgggggatcatctcttttgattgatttgactcttcttttaagttctttcaaacagctgttgtcactggattttcttttccacgtaattcacacaattgattggtgatgtggggatcattgaagcttggttgtcagtagtgataagggtcagcagtgtccatgaccacaatacttttgctaaacctggagagtgattgtatgtgttaaatgtcactaaaaagtaactcttggcttctttctggaataatatatgtggtttgtctattttcacttattaattttgtcagggtgggatatgattatcatgatctctttgaaagcatgactaactctaaagtgtttgagctttattttggattactttgctgtcatcttacccagtgttttgtgtgctgttttgtttttattctttaacttgcacaatgttgtcaacgtaatttatatgatgttctggtcagagacacagttacacgctgcagattgaaaagtacacacaaatatacccaccatgagtgcttcagcctcacgaccccagctcatgttaagtgggacatgctagtacagatgataaagtgaaatggagatacaaaggcagttcagatctgactgtcaatttttctcctttgtggactaattctgggtggtgaaaccatgaactatggaacgaagactgctccagcatgagtctgagttgaatcccatgtgagagctttgcctcctcagcctttgggcctttctttcttctgccctctggagggtgtcagagaacatgaaatgcaaggactttctggaaaggatagccagggtttggtctggtaactagaagacactttccctgccccttccccaccaccccctccaagccggaacatgtagaggtgaggagcagacagagagatggcagggaagccattggcaaggtgggaatcttaggaaggaagtgattccggttcttgaaaaagacaaccggattccattaagtagaatcggtatgaattgtactcatctctaggaaaaatcaattccagaagggtgagtaagatgaaatatgataagactagtgtgtgacagattcaggtttgaagcttaaggtggatggaatcgaaagaaaggtatatttggtgtcaagtgtttgtggcggcatgtgaaatcattatccacgtttgataacagtttgactctttgcctgctataataatagtagtaagtatgtatttaacattcaatgcgtaccttgtgtgggggaggcactgctaaatgctttgcatggacgtacctccttacctctatgaggtaggtggccattatgatgctcatagaggctggacagctaatatgaggcggagcctgtatttgggctcaggcagtctgactctggtgcccctgctgtgaagagctgtgccctgctgcattcctcctgtagctgcacgaaagggtgtggaatcttctagaaacagtgagttctatatgagtggagtgtggtggtgggagaatagatggagtaaagccttttgtgtaaacataccatgctaagtactgggagatagaaacgaaatgagagatttttttgttttgttttttgagatggagtcttgctctgtcgctcaggctggagtgcagtggtgcgatctcagatcaccgcaacctccaccttccaggttcaagcaattctcctgcctcagcctcctgagtacctgggactacagacacacgccaccacgccggctaatttttgtatttttttggtagagacggggtttcatcatgttggccaggatggtcttgatctcatgacctcgtgatccacccaccgcagcctcccaaagtgctgggattacaggtgccagccaccacacccagccaaaataagacatttctttgcccctgccaccaagatatttaacatcttacaggactaacaaaacctaacatgaaccagtccagattcatatgatagaatatgaaaatgttttctggaaagaatagccagagtcccagtctggttactagaagacactttccctgtcctttccccacctgtagcccttccaagctggaatgtgcagaggtgaggaacagacagagagatggcagggaagctattggcaaggtgggaatcttaggaaggaagtgattccggttcttgaaaaagagaaccggattccgtcaagtagaatcggtatgaattgtacccatctctaggaaacatcaattccagaagggtgaattagatgaaatatgataagactagtgtgtgacagattcaggtttgacgcttcagttggattgaatcgaaagagaggtatatttggtatcaggcgtttgtggtggcatgtgaaatcattatccacgtttgataacagtttgactttttgcctgctgtaataatagtagtaagtatgtatttaacattcaatgggtaccttgtgtgggggaggccctgctaaatgctttacatggacgtacgtccttacctctatgaggtaggtggccattatgatgctcatagaggctggacagctaatatgaggcggagccggtatttgagctcaggcagtctgactctggtgcccctgctgtgaagagctgtgccctgctgcattcctcctgtagctgcacgaaagggtgtggaatcttctagaagcagtgagttctatatgagtggagtgtggtggtgggagatgagatggagtaaagcctttggtgtaaacataccatgctaaatactaggagatagaaatgaaataagaaatatttcttcctgacaccaagatacttaacattttaccggacaaagaaaacctaacatgaaacaatccagattcatatgatagaatatgaagatactgtctctacttaagtacaggtgggaggaagactggaagatgttcctttgaattaagtcactttaaaacatttgctttcaaatgttagcgcttcaccatgggcacaaaatttgtcttcctccaggcttttggcctggcaaacaagaaccctgtccctatagtcagcagattcatccattttgagttgggaagcattatcttcagccttttcttcctgacaacgatcctgacaatcgtcgtcaggatctctaaagagatgaactcattagcctagtgaaccaacagtctcagctgtttatttaccagcacattaacagtttttccatttatatccactgcctgtgtgacgatcagcctggaaatggtttgagcatagggtgggaggggtggttacacacctggttgtaatccttggtttatttttgccctgtttccatctatacttcttgagagcttcctgtgttacaggcactgacctgggtgttggggcagagtagtgaaaaaacagactgggtcccccgcccaaggcactgtcttttcctcagatttcattcgctcatgtacattttcatagttgatctaaaagcggcatttggtgtgaattctaggatttcacacttttaggataatacagtgatcacactccctttctcctttgccccagccagtcctttctgaataaaggtcgagggattgggggaggaaggcagtgatgcgaatgggcctgtggggaggtcgcacgggcttgaggagggcagcatgtcgtagcgggccatatttgtgtcagggttgggaacggcacaaggcacacctgtttcctagtgctgcagaaccctcgtcctgggatgagcctgcccgctagtctgcatcctaatcctgctgttgattggagataacttcagcggtcacagggcacctcgtctccatggcaacccctctaaatattcctctagtgacttgtgctctacattctggctggatcagagccctcctgtggcaaaatattctaaagatgttaaaagagagagagagaaaaaaaaaggctcaactaataaatctattctaaacgactgagtcatttgttttgattacccgggtgattgccaaatgttaatttaaaactgaaataggccatgagctcactcccctaacaatgctgagtgtttgagctaatacggcttgataatgagggagccagatccactgccagtgctcatgttatatgataaacagacatttggagaagtatgcagaacatcttggcagttttcctttaactctaagggttgtaaatacaaagtagaatgtgttaccatgagccatttcataggaagttgactttatttttttagaattcagaactttgcttctaaaaaggtaactttgcctcttgattctcatttttttccctaacttaggcaccttggaagttgttttcaaccatatccagcctttgccgaatacatcctatctgccacacatccagcgtgaggtaagttttactaattgccacaaattcttacactgatctccaaccttctaagttgtggtattaggggcggcattgtacaaagggctttatttgtaccaggaggtttcagaaggttcattttaattgactcaaccaatgtcactgcttaccctaaatattagctctcgggggcaatgtcttttcaagggaaaatctcatttgctttcaacttgggcatatgaaaagggaatttgccaggcacaacagaactatttgaatgtctgctttaaagtaaagatctgctcatgtcgttgcacgaacagtagggagcaggaaagctgcatggagcaaatgctgggatgggacagaggagactcctgctgccagccacgagaaggttaggctgacctgatcagctattaggaatctttctccctgggtggaaggagccaaggtgcaggactggcattgcaaaatctggtgatagaaggccaaagagtgcttctgctcggtgacattaatagggtccaggagattttcttctgatttgccctcaagttcagaacaacctgtgggaagccagtgtaagaatgcttatactggataagcgttctctgtcctcttcatttagccacagtggcttgtttatactctgtgatgactcagggttcctcaattttctctttgagagagggacattgacctttgaaaataatgaaggaatctaagagaaggctcatccaggcacgatacagtaatggtccctcctttttggtgccccggtctctgtgcgctcacaagagggaatgtaacctttgccagcaccatacctgtcaggctttgccatttcatccctcaaaaggttgctgcgtttttgccttcaccttcaccctgcccacccctgcatgcagccacatggtcagtgtaggtacttagatttcagttagggtacatgctcagcaggtgacaagaattgcctttgttatgtctacttgctacagaattctccccaggttttaaaatatatatcttcaaatacctaaatgtattaaaccttaaagagtaaaaagcataggacaaacttttagaaatgctaaacctgaattttatccatttcatcaattatggtggtagtcggaagtccttccaaggccctcgggcttgaagcaagctcggtgatacaagctttcagcagcttccctctgctgctggagatggaatcttcatttctgggtctaaatcctgccatagctctcattcatagcctttacctataatggttgttttcaaacttaaaaaaaatgatagaaacctatcttcaaaaaatacaaatctttagatctaaccccaatagagaaaaccaaagctgaactgctttggctcaagtaggaggctgtgactctctgtcaccctcctctaagggtgaaccctattgaaagagcagagattttagctctgtgccctttcccagctcttatttttattttcccacagaagaggctagattctttaaggagatataaagaagggagagagaaagatataaagattctttaaggagatacaaagacatcctctcatcagctggaaatgccagctaggtgagacctgactatgcatatgcattgtttgcccttagtaattccatagcaatctgcaaattcaatcagcttcatcagcagaaaactttgatagaaaccatgtgtaaaagggctgtgttcttaaagtggaacatttaaatcgaagtttttcaagcacacatttcaagtggttttatgataccaagcacaccccagtgacatctttacattgaccaaaacttggtatccttgggttttcttttaaagcactgagtttctcaggtgtgtcagttgaatagaatctgctaaattctgttttttttatttttttaaattttttattgatttatttttttttatggagtcttgctttgtcgctcaggctggagtgcagtggtgcaagtgcagtggtgcgatctggctcagtgcaacctccgtctcccaggttcaagcaattctcctgcctcagcctcccaaatacctgggattacaagcgtctctacatcaacatgcctggctaatttttgtaattttagtagagacagggtttcatcatgttggctaggctggtctcaaactcctggcctcaagcgatccgccctccttggcctcccaaagtgctgggattacaggcgtgagccactgcgcccggccaaatctgttaaattctgtttccatgtaacagaaatatataggattacacaactgcatctggtgttctttcttcctttcttttattcattcattcagccctactatgggccagggcaggaatgtagtggtgagcacaaaaacaacaaaaaaataccttttgggtttgatattcttcaagggtgggacatgcctagattattttctcttttgcagacaaggaaactgaaaattgctttgcttttctcaattacattgcccagtattcagtagacaggtatggatgcaggggtacagttccaagtccccatctctactctattctttgagcctatgatttatgccacttccatataagcatgtgcaaataaagtattcagtaattgccatggatgcagctgtccctgggacccgaaggccctaaaatgaaaataaatgtaaactgtgcgtttcacactctatttttaaaacgtttgtttggaataattgaatagtttagtaaaatgggctttgctgtttccacatgaggatatcttgttcttttattttttattttttttgagacggagtctcactctgtcgcccaggctggagtgcagtggtgcaatctcggctcactgcaatctgtacctcccaggttcaagcgattctcctgcctcagcctcccaagtagctgggattacagatgcgtgccaccatgcctagctaatttttgtatttttagtggagacggggtttcaccatgttggccaggctggtctcgaactccttacctcaagtgatccgcctgctttggcctcccaaagtgctgggattacaggcgtgagccaccatgcccggcctattttgttcttttaagtgatggtgtgtccccttttaatacagtatttatcatagataaactttattattcagaaacttagaattattccatttggctgccttttagtttacagaattatttggaacacaagcttgaacacataattcttaacacatacgtgaactgggctaaatttgagtatttgtaccatagtagtgacaatattgttaattaaacatgtgtttcacatgtaggagatatttgtatcactgacatatggtcattttcattattgatttggcagttttttaatattcacaaaacacaaaattttgaaatacagtagtcaaagtgatttgatctgtgccatttgtattgatgtaacctctcttcttggtgcactagcaataagaaggagaatcagcacagatgggttacacagacttagaggatttggaaaccatcactttagagccaaggtctcaaactgatgggctggatctggcacacagaggtgttcttttaaaattttaattgccagcatttaaaaattgaaaggtttcatattttttgaagtccaaatttttcagcttctcttgaaatatcagaagatctggcaatattgagccctcactcctgtttggctacactaggctggagccaaatggctgctgtttcttttctttttttttttttttttcctgagatggagtctcgctctgtcacccaggctggagtgcagtggcgtgatctccgctcattataagctctgcctcccaggttcacgccattctcctgcctcagcctccccagtagctgggactataggtgcccgcaccacgcccggctaattttttgtattttttagtagagacggggtttcaccatgttagccagaatagtctggatctcctgaccttgtgatccgcccacttcggcctcccaaagtgctaggattacaggcgtgagcccccgcacctagccagctgctgtttctttagctagagcatgaactctgaagtttgccacagtctctggcagtatctgtaatctccttgacactaaggacaagggttggttgccattatctgaatgtttaacccctatagacatgtgagttttcaatcccaggtctagataaaattgaggttgcaaacttaaggtcatcctttttctcaagatatcagcttgctaattttcaggggcacgacatagggtgacagtcatattaaggaggtgctttaaaagggttgagggcaaacatttcagaggaaggttactttctgatgatggtacctgattaagaaaaggatacatcgacaggtacgggtgatttattttattctggcagattcctgtagtctactttggtgcttctcacactttaatgtgcagattctgatgcagcaggtctagagtagggcctgagatcctgcatttccaacaagcgccaggttataccactgctgatctgaggacctccctctctttgagtagcaaggggactctaaaagcaatcctaagaaaaatcagtcaggcagtgatggtgctaatgtttagaacattcacttttctctagcctgagaaagaaaaagagatacgaaccagggtattttgggttgaatcttcccagataaatctggatctactttgagttggagcagaggagatgaaaaatcaattattttcaatacagtatagcacatgggaaagataaatctaactctgattttaaaatttgttttaaattaagtgcttctggtaaaaaaaaagctagatatgctcaggaatcatgaaatgtagggattagagcttttaattttaggaaaatatggggctgttagcaaacttgtaaatcagaccacagaaaataggataattatcaaatccctggttatatgataaccttgtaagctataaaatgattttaaaaagttggaaagaaagaaatcaacagtttcaaatatatacagtcctatattgaaaagtataattaaaatgaaaaagcacaccaggaaaaatctgtggcacagatgacaagatacataatttctatatcatgcacagacctcatacagattgtaagaaaggtgcgcacaggcctagcacgtggtaggtgcttcctaactgttggctgaatgaattatccaattgatagatgggtaaaagacactcaagttatatcacaatgtaaagaaatgcatggaaaacactcagcctcactggtatgcaaagataagcatatttgaacgtcagcaaggcacacttttactaagttagcagaattacaaaaagaaaacacaatgttaatatggttaacttgaaatggatatgcacttattcactgctggtagcaaagtaagttggtacaaagccttttggaacattgtttggcaatatatgcctaaaggcacaaagattggtaccctttaatctagtaatcatactttgggaaatgtgttctgagaaacaaattattctaagaaaagaaaaaaagctgtgtaagcattcatcacagtgttatttgtgaggacaaaaagaaagaatttaaatgtctaatgtgaaaaaaatagttcatttattcaataaatagttttgattgagtagattatgatacatctatgcagtggaatttcatgaatctgttaattataattttcacacttacattagcaatatgaaagaatttgtataatacagtcttactaaaaaatgcaggatgcaaaattgtatatatgctgtgattgtaacttgcaaagtgatatgtacctgtggacaagaactagaaggcacaaggaaaaaatgtaagtatcactttatttgaagttgtattcatgttgtgatgttgtttgtacattttgctattacttagatgttgagaatcttccacttttatgtacttaactccatatcacaagccggatattctaatctatcacagagtgcttagtaagtaaccaagaaacatgaggactcctgtctagagcctaaacatggggttccagtgctctagttccttctcgcttgttgtgtttcatcatccagagcccccatttctctttcttccgtatttggtggttggtagaggcatcttggtatataccacatgacaccaagtataaatatttgtttcagagcttttaatgaatgtctagcagtgccaggcagggaatgaattttcatgtttaaaggtccagtgtccacttaaggaacatcttaatggagctacagctcaagagcaagcccatttcatcttctgatttccattagataagcaacaaaaattggctttaaggtcatgagcctccttacagcagtccctctcaccttcagctgtattccctatttcagatatacttgtttctctgctgtaagtacacttttcttttctaattaggtcagttacttcatgtctgtttttcttttttgacatggtttcttctggctttggcaccacatattttccccatatgtcattgcctctggagcttcatgttgcaatagtttttcaaggggaacggagagcacattgctaagggtgggggatggcttttgcctcttttgcctgccctttgcttcagtgagtgttcgtatttctgttgggcctagttctgtttggttttgtagtcttcagagtcagttatgtttggactgaaagatacttaagtaaaaataatggcaagtcagagatatgtctggcaaaggtgcagcacatttgttaaggttactggtttatttatctcccttgtctctatggtgactaaatctgggtctgggatttaatggacttagttttgacctcttgtaacatctcctaacttttcccagcctctgatttagaaagaattcattttcacttgaggagagaaactgtctcacttagaaaaggggtcctaactggactctcgaaaagtggaatctctagtctttgattcttacacagtcttcaaccagagtacccattgtggttgtaaagaaagctaagaagtcatgtagaaatacacacacacacacacacacacacacacacacataatgtctcaaggaaatacttttctttttagtgaaataaagtattatttagttaatgtgaatgaactgtctgtaaagagaaccttttgtcagaataccaaatcaatggaaccattgactggacattatgtttttattttttaaaagtatctcctttacccattacaggattataaatttgcacacatataaatgtttgaaccatatttcagagttcaagtgtattaaattgtgccatggaagtccacaataaagattgggtttgaccaggattctcatggaagaagtcagatttggacagctaagttcaaatctagtgttccatcttcacaattgatgtgaaatgaggacatagatatctgatctctaaggtaggtagagtcaaaccatcttggacttcagttggttcaaatgagcctttaaaactttttctcttctcctgtatggtgctttgagacttataaaaacattccagctgtaagaatttactaatttgttcatctgtttacaggtcttttcagcttctctaagaataagctcacatgtgaattttctttgaaaccccaaaacaaaggagtcagtaaatgattgattatcaagtattgcacagagactgaggcaagggaagtgacaaaagtcctcttctgtccttactccccaagtataaaatattagagttcagatctgtcatcaagtttagttcaagcccaataggaacttgtgattacttagtaaggtttttgaacatcataaaagttcagtgcatatggaagttgttgtaagattttgtccatcatgaacgctcctattaataggcaaagatttgagaagccaacaacagatgctcacttgtaagagagaaccatgcctgggagatgaatgttggatgctccttaacttctgagtttgaaaccttgactcacttgtcttataaccgtggacgtagaatatttgttagattaaggtcatagctaagtcatacaaattttattatgatcagtacagtaagcatagctggggtcaaagcttttatggaaatcacaatgttaaggcctgaagtccttaataatgcttgagaaagaatggcacttttatcatcatcattatcattgtcatcatcattattatcatatcaaccttatatcacatgttgaaagcccagtgtggtgaactgtgctaataattgttataatttatgtatttcattattgatatttcaattttgtttgaacaactgtagggatcaatttaaaataaaaaggaggaaatatataaaaatgtatttagaatagtagcctcattgtcttgtcttatcagccagataagctttgtgctttgtagagcatctctcactgaaggatacctaattattggataaacaattagttctttaacagttcttaggctgggtgcagtggctcacgcctgtagtcccagctactcaggaggctgaggcatgagaatcgcttgatcccaggaggcagagggtgcagggtgcagagatcgcacgactacactccaacctgggtgatagagtgagactctgtcaaaaaaacaaacagacaaaacaacaacaacaacaacaacaaaacccaaaccaaagaacagttcttcacctaagtagaaaagcagaaaaacaatggtttgaggtctttgtgagtctgtggacatctcttaaaccatgtgtgagaggaccatttctttttctattctttttttttttttttgagacatagtctcactctgttgcccaggctggtgtgcaatgacgtgatcttgcctcactgcaacctcttgctcctgggttcaaatggttcttgtgcctcagcctcccgattagctgggactataggcgtgtgccaccaggcctggataattttttggtatttttagtagagacggggtttcaccatgttggctaggctggcctcgaactcctgacttcaagtgatccacccgccttggactcccaaagtgctgggattacaagcatgagccactgtgcccagccgataggaccatttctgtacacattcattagggctacaaattcataatttccataaggtactctctgtgtttctttcccaggaccggtagagtttttcctatgggtggtggtgagagtttgtgtacataattgtcagcgtgcacaggcatagggatttataatccagagggtcttttgctccctacagtggttcaaatggaaactaattggagagggtgagttccaccctttgcattgggctcatgggacaggtttgaactggaaaacagtacaacatgctccagtatttttagcctatcccttatgttcccagctctgccgtttgaactgtcagttctcatagacttcacataggatcttgacctgacttttggtcctctcgtgggtgttttccattttccttactggggcaatctaaggcacaaagagtaaaggatttggtcagagttactgtcttaaattgtactctgctttctccaggaaactggaagcttctgaggagcaagaagcctgatgtttcctcttatgtcctttgtatcatttattatttagtgccagagacttagtaggcatttgctagagatacaattaattgaatgaaaggcattatgtaaattacaaaccatagcattaccgtggtattacacaggactgtcttaggatccctgttcctctaatatccatattcctgaattgttggaggatatgcttgaatagaacaatcccttttccttcactgtagcatgacattatttcttcccggcctgttatcagcaagtttttcgaacagaaaagttgaaattatacagtgaacgctcctattcctaccacctagagtcagcaattaaacattttactatatttgctttatcaaatatccaccatttacccatcttaatttttggatgcatttcagagtacgctgaaggcatctgtacgctttacccctaaacacttcagctttatcattatgtggtttcaattttgactttcttagagctgctttcaaatttgttgagatcctgacatttattttggtggtggctaagaagacgtagtaactcaaatgtgcaatatgctcagttttcagaccctgggagtttctctttgtttgtaactaccagcaagtatacggacacatacatatcgctgtcccttccccgcttcgttatatggtcacattatttgtattgttgaaatttggaaagccagcctaggaaatgcagttgaggggcttgtggatatgaatgaaatcaaagaattggggttgagaatagtagggcaaaaggttagagttagctactataaagggaggatagagttgggtataaggagtggggaagagattcagatcaggaagttatcagcatgataccactttcatatatgaagtctagagagggtttggtggctgttcatatgacctaaaggtcatggattgaataaacactaagagtgcaaatagtccttccagtctagtggttttcatattgtattccatggaaccctagaatttatagacatgtctcagaggttttaccaacatttgaattatactttcgcaagtatattgaactatttttaaaaacactaataagaaaacccaacaaaaacacttgactgtgttttatagaaaattttatcatcctggagaacacatactgattgactttattttattttattttatttattatttttttgagacagagtctcactctctcgcccaggctggagtgcaaaggcgtgatctcggctcactgcaacctctgtctcccaggttgaagcgattctcctgcctcagcttcctgagtagctggaattacaggcgcttaccactacgcctggctaatttttgtatttttagtagagacggggttttgccatgttggccaggctggtcgtgaactcctgacttgaggtgaccccacccgccttggtcccccaaagtgctgggattacaggcgtgagccaccgcgcccggccctgattgactttaacataagtaaaggttattaatgtcaacctaaaataaagttttgactaacacttatctgtcatccatcaaagtcggggtagtatttctatgtgggaataaagacaaaaggtccacagcaggaccattacactaaagccatgggtgttaaggcattggcctgcaaaagctgaagttacgttttggtttccagttaccatgagcacttatccatctgttatatttagatttttttttctagtacctttaggaatctgcaaacagacgagtatctgctttaaacttgaaacgaccataaaaggagagagatggttaggatgccggaggctggctacactgtcatccttcagatgggcctgtgtgaatggattagggaaccttcaaaaaggtctctcttctggcccaaactgctcaacctggtctgaaaatgtatgtgtgcaatattgcacttcatgatgagatgtgatgttcagggcttctttaataatgcctagaaaaaccttaaaatgggcttggcagatttctttcatttggaggctgtggtactcaactttggtgtttttcattccagactgtaccacattctgtgcccatagtttgaaaaacattttggaagccaatacctgcttgtgtgtagctgcagtcagtttttaaaggttttgctgatgtatattttattttcccctaacctttattaagatcttcaaagttgaaatgactttgcagtggccatctttatccccatcatcaacaggctgccattaatagcattttattctacctgttttattactatctatccatccctccatccatcagtctatcttatttttggatgcatttcaaagtgaatgtagcagatttcaccagttaacttcataatattttatacacttgaagtctagctttttgaacagtacacaaatgtgactaaattgctatagaatgctgttaaagaaggtataaaataaatgccccagttttggaaaaaatttaggagccttattttaaaagtaacaggtattctggaatcctggcatggagttggaaaaaaatatactaatttttaaattggaacttttttgtaactctgacattgctgacccctaaaaaagaggggatacacttgtaaattttattttcatcccaggcaggagttaagtaacttcccgttcttatagagaggcaagatcatcttgaaaagtgttatagacatagaatgttggttacgcccacagaatcaattgcatttggaaggcagaggaacagttaactgaggactaagttgatctatgcagggtctgagtccaaaccctggtgtcaaggtgttaagtgcaaattattattattattttttaaagaaaacactcttgttacaatttggacagagagaatggtatggagatgaaaggttctcgtgtatggcttttgctcctatttatgtggaaagcacgccctacattctttcaaagctgtgttgttccctttattctcagtccccagaattgtgtgcaaacacactctcttggcccaggggtttggctgggtgtgtttccttctggaagtcttcactagcactcttgagttagctggcaggagatcccttaaaaccatttccaagcagtttttctcacttccctataggggctaatcctgtactttccacttcagttccagctgctgttgcttgggaagaaacaaatttctgctgtgttctcaatctccagacggtccatgaaaatttaatgtataagaacaaagaggctgggcgcagtggctaacgcctgtaatacctgcactttgggaggctgaggtgggtggatcacctgaggtcagaagttcgagagcagcctagccaacatggcgaaaccctgtctctactaaaaatacaaaaattagctgaacgtgatggtgggcgcctgtaatcccagctacttgggaggctgaggcaggagaatcgcttgaactcgggaggcagaggttgcagtgagccaagattgcgccactgcactccagcctgggcgacagagcgagactgtctcaaaaaaaaaaaaaacaaaaaacaaacaaacaaaaaaaaaacagaaaatatattttgggcagagattagttgggggatgtgggtgggaaacctggtgattagatatatttaaacgtgtcatgtcagtatagagcgtgaattaaaaataaattatatttggagagttgtaagaaatttaccagtcccttcagacagacacatgaccctttaaaactcattaaaactccttggcacaatggaataacatgcactttggtcttggaagaaaccattaggttgcaatgtttttgatttctctaccactgacttgctctttgatcttggaaagtgactgacttgtcctgtgattgtttcataatcacccataataaaactgacttactgtatatagtgaatagttaagtttaaaactatatctagtttccgttatagctcaagtttatgtattattttattagcgtttagatgttaacattaagctttcaaatcagatgaaatttaatttgaaaaaagttttcgtgtatgaatactttatattctgcagttcatacatgcagtaccacccttaattaaatgatatttccacaaatcagtttggaagattttcttcctgcaaaatgtatgtttaaaatacataaaaattgatgggaccatgtacttatggctagtcggaaagtggaaagttttttagatttatgcttaggacaggtgatagtacttgagcttctattcttagtttgaccttgcctcccccacccccttaaagcaagacacttaatctctttaatgtctcagtttattcatctttaacacctgtattcttatttcatgaaaacaatacctggtttatatttggtagcatttaaggacttgatatagaaggtggtatggaagttcaaattatatagaaagtatttgtatgctgaatgataatcttgacaaattactgattactacatttagaaagttacaactctggagggaattgatatttgatattgttttcctgtgtgttctaagttaccaccataacagtaggaaaataaaccctatcctggctgtgttacaaagggattaactcacttcttcaagttgttactaaatctccagccctttaaacaacagaaataaaaagtgttccttattttaatttttccgaaatgaaagtcctataactaaccttggcttaattttttcttttgttgagggctttccaagttattttctttgtgaggaatggaggctaaaccatgtcagttgcttgaagcaactaaaaataccccgtacaaatatgcagaggagtatgcttttgatttttagatcaaaacgaagaagcaagattttatggagcttgcttattatacatttattatactgagctacttgtgccttttcaaataattaaatattaactaaatacaagaggattaaatagctagactttaaataaaactaaaatagccatattagtattttctaaattctgtatcattgaaagtttaggctgatatgaaagagagggaattcctatcatggggattgccagtcttttcacaaagacctgccactagattttgtagtatatgataaatgtgtgtgtgtttattgtgaaaattgtgtgagtcatatgaaaaattaagtctacttgaaaaatcaaaagacattacctacttgggtacaaagcctgatttatatatatatttctttaatgaccatattatgttatgttaaagtttgtatagtacttggacatatattatttaatttcattcctaaaacaattcaatagggaaagcaagacagatattaatattcccatttcatagatgaggaagaaaaaataacttggcttgtaagcaattcagcagagtcagagattgcatttgagatttttgattctaagtctagtgtgctttccttgggttacaacacaataaagtcaaaaacatttactgttattttcattaattgaaagcttaaaatcaatttaaaattctaacagtataaaatttaacagtataaaaatattgttaatttaattttatgacgttaatttttaaattgatttttgaatttgctaaaagtgttttaaaatcagtatcctgtttcacaattcctgaattaatctcttctctgtacatttcctgttccagtatgataatttatataggctttagcatttacttatggtattaaatgagtagacagttggaagggaattaaaattaattaggtcttgcagttcttataatactcctggtttgccacactgaattgccatgacgtggctggggatccctgttttaacatctaacaaagatagctgccagtgtacttaattttaaaacggtctcatctattaagctgctttataaacatcagccccttttctgaagtccgaagttagttttttaaaatattcactgataatggagtgggggtgctggtgacgtttctctttcttgtttatctgtaaagacagggaggtgcaatctaagttaggaaattggtgacaaatagtcatagaacatgggtcacctggcttcaattagttatgtgacctttaagaaaacaagtgcccgtttcagaaaagactgacctttgaggctagagacatcaagctactcctctacttttaggaaaaaacaatgacagggttaatttaaaactctgatgcagacagagttgaaaaatccatgacagatttatataacgaacgtggatggtgttttgttttcccagaatgcagttttaaggtcagacctatgactcagagctgtgcacttccctggtggtatgcatcagtgacatgttgccagtctaatcgtccagaagggcttgtgcccagctcggcttgctccattataatccccagctgagaagccacctttcattttttttaaatagataaggaagacagcatgaacatttgaaactcaaatactatatgtagtttataacttttcagcctgaagacttgatgcacactaagttgcctctttaattttgagaagtataatctccattgccactaatccatcatggtgtggcactgcatgaggatatgttgtgtgcattgtcagtatcggcgttttgctgagtttactgttttttagttcattggcaaggcatcgtgggttttggtgcaaagagcatggatttggaatcaaaagccacttcctctctgggtggctgattagctgagggtaaccttcatatagctggcatgggatttccagatggcatcctctctgcatgaacaaaaacaatgtgccatttcagtaaactttggtgggtgctccctcatccactccagatcttttcatctctttccttttattccctccctttccttgtaaatcaaaactcccattcctttagtgctgctgatctcttttgggggttagaagaaagcagtctgattaaactaacttactactgtttttagttggttcatcctatctttaaaaaatgtatatatttcaaggctgggtgcagtggctcacatctgtactacccagcactttgggagaccgaggtgggtgggtcaggagttcgagagcagcctggccaacatggtgaaactcttttctctactaaaagtacaaaaattagctgggcatggtggcacgcacctttagttccagctactcaggaggctgaggcaggagaatcgcttgagcccgggaggcagaggttgcagtgagccgagatcgcaccattgcactccagcctgggcgacagagcgagactccatctcaaaaaaaaaaaaatatatatatatatatagatagatagatagatagatagatagatagatagatagatttcttacagcattgtgataacaaatatttgtcaataagagactaactgtggtatagctttacaattggatactatgtacatgttcaaaaagtagaagctctttacgtactgacaaggaaaattctctgaatataaataaatagaactagcaatagaattaatagaaaaagcaaggtgcagaggagtatgtatagtataccactatttatgtttttttttttaaaagaggaaaaagaaaaaatatatagctgcctatcttttataagcccagtatctccagaagcataaagaagacactggtatcattggttatcagtggagagggggaagtagatgtctggggatagatagggggaagaatacttttcactatgtattctttcatacttcttcaaaaatacatctttggaaataaacccatgcaaaaaaaagaatgttcacagcagtattatagtggctaaaaagtggaaataacccaaatgtccattacctgatgaatggttgaacaatatgtggtgtatctgtacaatggactattattcagccataaagagaactgaagtactgatgcatgctatagcatgaatgaacctcgaaaacattatactaagggaaagaaatctgccacaaaaagctgcatattgtgtgattccatttttatgaaagcattatgctaagtgaaagaaatcagccacagaaggccatatattgtatgattccattgccagaagtggcacatccataaagacagaaagtaggttagtggttcccacggggtgggggtggggtatgcagagtgatggctaagaggtccaggatttctttgggggtgatgaaaatgcagaatcagatggtggtaatgattgatatacattatgaatatactaaaagctgctgaattgtacactttataaaggtgaattttatgatatataaattattttaaattttacttagagatggggatctcactatgttgcccaggctagtcttgaactcctggcttcaagcaatccttctgccttggcctcccaaagcacaggcatgtaaattatatctcaataaataaaataacatagcaaaacaacttgaagtcatgaacatggaaacttaaagaatcactgtgaacatataaaacaaaagttttcacctaagaaatgtttttattctaaaatattttacatattatctctataatgacaaaggacttcatgttctttagctaccttcactcacactcacctggaattatttcattttataagtgaagattgttaacccaaatgaagccctgattgataaaattttgggtaaaataactaaagaaagaatgtgtgattatctggaattgagatgttgtagctgcaggccttgcccaggctgtgccagtaggagaggaggtacggagcctcagagaatcttttggaccagtgtgccctttctctcctcacagctcatcccagagctgtccctgcctccttaggctgatatgcccctgttcccttccttgtgttctcctgcagtgagctgaggcacagggtttagggagcctattatgataggaggagattaactttggggttctgggatgagatctgtggacctgaaaatatagcctctctgatcctagtcactaactgctcatgcatggagagtgacagctaagaggtccggggtttcttttgggtggggatgtgaggtgctgggtcattatggacatacggcaatggtctgtctacacaatggtcagataatagtcttcttacagtcatcccaactctagatgctttagccggagttcatcttggggtgggtatgggggattgaccacaacgtgtttttggtcaagagtcgggtagatggtgcatattttggttctgccacccctgggaccttgggcattgctgtactcacccaagctatgtctcggcacaaacagcctcatctcctgagctgtagagtcatttctgtaagtggcttgatgagatagggtcttttagatccatgtccttggcatttattcagaattaactcacataatatgatgctaatctgcattctggctggagctgcatataggtagcctcttttcattgttggcctttatagccaacttaagctcagagatgtgaatcaagggtggcctgcctgatgaattagtgcttataaggtaaacccttatttgttgtgttggaaagtttattgactctagccagaaaaggtctaattagccactgggccctttcctggcagggaggatgtagggaagaccctctgcagctcaagactggacaggtgacctagacctattgggtatttatttcattagaggatcaatagagcagagatttgttctccccaggtctccatcatctgttcataaaccctcctgacccatgttgagtccacagctgtctccactgggctgtcaagctgctgaggccaattcctctgagtccctaggactttgagttttgctctctgctgccccagtcattctcaggcccatggtccttgcagctgggctcttggccaacatcctgagcccttatctcttttccacatattccctgtgaattagtaaacttgataaattctatttgtaggaatctgctgcttgggtcggccacatttttagcgtgtagttgaattaataatatatagtgcttactgtgtgccagccactgctctaaatgttgcaaatatttactgctgtatttctcacaatgacccttttacataggtactattatcatccccattttacagatgggcaaatttagtcacagagaagttaagtgaaacttgccaatgtcatacaaccagtaagtgatagaggcaggattcgaatttagatattctggcttcagtctgtgctcttagccactgcactatattctcttgaatcattataaaatagatatactaatctcagggcaaatttcctactatttgtcttggaactaaccatgttaattgttcaaccaatctcatataaagttaagccttaaatttctttcatggaagccttcaaaaatagttatggtccagtctaaaccgttttacctgaatttcattgaatgcaataggacaatcactccttgtttcactctctgtaccttagataatctggtcttatttataccagttaggtacctacttcccatgtttgttcttgttgattatcattggaaatgagcaagaagggtggggatgtgaggtgaatggggtgtgatctttccacgtacatgtcctttgatggcttctgctcctctagctgcagactctccttgcgttctcctttctggacttcgtgttcctgtcattctgtttcatgtacttgctgcctggcatggtgaacttgttgtttgacttcaagggctttgaaatcactcactcttgttccttaagtgtcagctgtttaggtagagcctctgcttccgcatccaacctagtccatatctctctcagctctgcgtcaactactgcttccaagttagccaaagtttatccataaactttgtttttctttttaagtttaatagggtttaattgagcaaagaacgattcgcgaatcaggcggcctctcgaaccagagtaggctaagagactccagcattaaccattaactgtggctgagataacttgactggactcttgctgctgcatgagagaatctgcaaaatgtgtcatctacacacacaactgtcccttagtctcagggtctgtgacccagcttaacctctgttgatgaatataaagtcaagggataacaaaccccctttaccatacatagcattcctaaggtttacattgtcatgagtaaagatcccttgctaatacggtacaaggaatagtgccttcggagtccagacactcagcttctagacctggagcagctgttaactcagggaagcaggtgatctctccatctctgggcctcagcttttccatctataaaatgaggtgattggattaggtggtatctaagaccatttccaactctatcatgccatttttatgaagctggagacaccctcagacctggcccactttatcttcaggtccgccaatcctctccaacttgtggaggagcctatactctgtccttaccatgcacaggttgacgaacagggaagacaagctgccattgagggtggtaatctaatggcagaccacacaccaacaggatcactctggttctgcagctgagttttcacaaaacagtgcctgtcctggcacaacagaagagctccttccacagaaagttattcctatttgctctctcagatacgaatcactgtgggccaccgcgctcctctgtccacctgtggttactcctgcattgaatctgaatcaagacactgctcaggcagtcaaatgttggccttcggggaaacttggcagatgggagccaagtgagctttcactttatgtactttcagtcctctggaaatctggatttcccctgctatcaaaatagacaatgctattgcctaacaaaatatagacttcctgagtgacatccaggtcacggcttgatctctttcctcctgctgtgttcatgcttccacttccgtgcaccatgttaggttcagatgatctactgaccaaaccccagagaaccactcatgagtcttttcaacctttaccttgaattctagggctatcttctatttggggtttgaaaacaccagtgcataataaagtaatgtattaattatagttttttggtaaataaagatagatcgtatgttactagccttgatgtttcacacaatgaagcagagctcatgaattattataacatccctgatcaaggcagttgatctcagttatcagcattaagaataaaggtatggatggaagcttatttgatttgttcttctttcctattatggatattaaccagctgggtaaattatagaatagggtcatggaatgtttagccctcaagcatttatcagaggcttaaaatgttcataaaaggtgggcttggtgaatgccaggacttagcatggttgaaagggtgttttgagtcatggtacatggcaatatggaaataaaacagatatgtcacaagtaggtggtagaaataaactggaagagaattttaacatctaaaatgtgacaaagatttatccttaccagcttctcagtttcctgaaacatttattttcctttgattttagattctgtatttatgttatatatctctttctaaaacattttcttgtttctgttttctttacttcttttacttttttgccacttctgttttttgaaaaatatcatcctaggcatgctctgaaagtcatttgttcggtgttttcctgatagtgatttctggttataggcccataaagtatctgtaggatgtggttaggatagttcctacctcttggtaaaagtctagtagtaacacaggaagggcacagactttggggacaagagacatttaaaactgttactgatcatgacattaccaaaaatcaaaagacaggggccatggctcatgcttcgtaatctctctgtgaatattataaggaaaattctaagccctggtcaactgtgaaatgaacaggtcttcagtggagttaattagcattttccaggtgctttgctgtttacagtgtcctttatttcatgtatcttctcatttgttacaggtcttctttcataccttttccttttctctgagattcagagaccctttggggaggctgaatttcaggtttgttttcattaggaccttacatgaccaaatcccccctcttggggttccaggggtgctccttcattttactctctgatgggtatgccatgaattgtgacatttaagcagtgactttgcaaaattggacgtgtcagtaggaaaaagtactcttcccaccttaaagattgacaggaacatgagatggctgaagctgttctgagcttttttctggcaagagtacataggacaagaaatactctggagagctcaacattgaatcacatcatatcatagtgcatgactagttgccttaatcttgcagttggactcactcaggagaaattgttggcagagggattaagtagcctgacaaaattatattgagaaaaaaacttgcagtctattaatttattagtagtagatatgagggaaagaagagtcatgtaaaaaaaaaaaaaaacaactggacatgaaaccacggagaaatccacaaagactccattacagtttgttatcagcctcttgcccctggccatgactaatggccagtaattgtctgaataagtttttaaccatttggaaatttcttcaggaaaagaaaaatctagtaaagggagaagggtgaccacaagtcaagctgtgaatgaggaagtcctgaaatgtgggctaagtgggtcactgaatttgccgtgtttgattcttcggttgcaccactttgaacttttgaagtttgatcctcccagtggtgtttctgaggtagagaggctaggattagattgcagtgtgagaaatcccacaaacgtgattctactgtaatcttactgttctctctcgctccttgataactgggatcccattaaagggggttcattattgacatctcagaagaaactcattgtgaagtctaaaataaagtgccattcttccctacaccagctctgcctcccatattccccattattttcccagtcacccagagtcacaacctcagagagatccttggctccttccccttctttcagttcttgtagccctgtcacagtgtcccttatatctagtttttcctttccatgcccattgcccctgcctctcattctttcagtctttccttgcatctcagtggacaattgcattaccctgtgctgtcttccctgcctcctctcttctctgagatctgctcttcttatcactgcttgcatgactccatctcattctccccttgcaccagttgcagaaagatcctccgtgtgtggctttccctcctctctagctttcggtcctactacttccttatcttgtgcttctgtcacaccccaaccccccccagctgcatcctgcttcttgaacacgtcctgtgtttttctcataccttaggtgacatggtaccattttcttggaacactccctcccccttgtctgcatgccaaagtcttaatcattcttcagggaccaggtcaaatgccgtgacatccatcaagtcttttctcatctccaaaccagatgtgatctctccctgtgataaatgtcagtaacactttatacctttcttgtaatacttgtaaggctctgccttgcatagtagtcatttgcatatttatcttgttacacttgaaagtaaggactgtattttattctttgtgaccagtaaaataccttgcaccacatagtagggcatctgtccaataaatgcttgtcatatacaataaagcaatggctggggcggcattatctacaggttaacccaataataggtcataatgtatctgcagatagtaggaccataaggatgtgtagataaaccctgaagtaaatgattcgcagagggtcacatggaagggaaacagggagtttgatacctagcactcactgaaaaaagcgtccggatactgctagagtgtgagactagaaggcctgaaatgtaaccatcatacaccaaagagagttgctcccaaacaccagccaactccaccaatagtatataaaggtgcgttgtaaacagtacagtgattcttaaagatattattaaacatcatactgttaatatataacaagattgactaatatgccaatgaaacccgtgactccaggtacctgtgaaatagccagcaagggttctgagccactgatccaagacaggacaaagttaccaactattcttcctaagaaattgtttctcatcatgcaaggggctgtttctgtcttggttttgtggaaggtctaattctgtggcttgaggacatctgcagtagggccagatgtcagagcaggtagtggtcatgcttcatgaagtttttaggagggcacagttacctggttgatgcaaatggaagtaactggaataaatgctattgttgcaggcccaagctcccagtccatcctggctggtcatagttgactaattcatggtggtcaaaaagtgattctcttgtctttgaattttctcttgtattttaggcaaaacagatttgttttttgatactttcataaagctgtctatccatattctgttgtcacttttcaaaatgatcagaaacctaaagaactaccatacttgcctaaaagaagacacttcctgatgcatagcttgaaacaggaattgacttcctaaaggaaagtatttggcacaccaagcctattgttcacagcgctgcaagagaggcatttcaacatacatgggctcttcctaaaaatataacttgctaaaataaaaaattcagggttcattaaggttaatcatctaataaagtaagagaatttcctctaggtgaaaagtttcagtttattttaggggtgtggtgttgttacaactggctaatctccgcaccataatttaatcaggctggatgagaaagagactagaaaggcgtggagccagagcacagtgtagcttctcttcttttcccaggcttatttttttcctctaacatgtaataaatttactcgtaacaacctggcttttattgtgtcattttctagctaactgggagttactgatgtcagttgtcttttagaataacttttccttaaacatttgaagatcgtaagaattggggaactcattcattcatttattcatggagcatttactgctcacctactgtgtgctataggaacatgaagacaagcaaagcactgccctggccctcaacctggtaggggagatgtgtgaatagggccaaaaccacttaaacaagacagtggctataaaggtgtctgtaccagcgagaaggtcagctgccttccttgaagttgagtggccaaaaccactttcaggattgcaggtgggactatgttttggaggcttgatggatttttcagttatttagttcattctttcaaggaatagttattgagagcctcctgggagctgggcagtgttctaggctctggggccactgcagtgagctccagtactaaatccctgccttcatggagcaaagcaggagatcagacagcaaggagagaaatcagtgcaataccagcagacttgaagtagggaaaggaacaaccatgactctgggcacaggggacagtgaggaggccagtgaggtgggagtgagggaaagggggctaagggtaaggccagagaaggaatgtggaagaaggtcctggagggacttgggggctttcttttcctagaacatgctcctaatagccagcccccagacatctgatggcctgttgagctattacaacattttaggttgatgtcttcattttcattcatgtttttccttttattgtccctgatgctgaaaaacaagaggttgagtttgtgagacaaaatgtcttcattgtgtgtgtgatggggataggcatagtctccccatcttgttctgtgctgtctgccgttaaggaggtggggagattacgatcactctcctttcctgtacagtaatctgctgatctctggaacatactaaggaggacatagagtgacaacatctataatccccttaatctctatattcatactgtctaatctccttgagttacactggtaacataagtctatctcttagagttacttttatcattaacagcacaaaaatgtattatttacagggccaaatgcaagctcttgaggcatataaagtggattaataaggttggctcagcgttaagctatgccagagccgagtccaaattttattccggtacagggatgactttctatgtggcctctctggctctggagctaatttggatgctgagtagccccgcaggtatttatatgtagcgtttggtatttttactgggtcctattcttctcccttggatcacctaaaatggttaagaattttctagtgggattaaggttgtgatctctggggaggggtgggacatctgctctcggttatttttgtgttagccgcttccccttaaatgtatgttcacaaatgagccacagccttatcagctggggttgagggaagactggtctaggtgctgctcctgaacttggtctctgagccatggcttcccatagacactcaggtaaaacttcatgctctttatcttatattgagcacagttttgttagggcagtgaatccgtcattgggctaaaagatggtttttgatgaaatgattttagtcttgtctgaatagtaaataaattatagcttgtctctgttttgcctttgcctttcatgctatttcaaagacaaaatattgttcaagtacaatgaacagtttgagtgatttattttaaaaagaagtatataaacatgttaccactatatttttacctttttcaggacatctcatgaaactataagagattgtgggaggaaaggtttttctggttaggaatttttggctttcttttttataagatacaattcttcatcttgacagtgctttacatccaaggtgtttggagaaggtaaatcgaatgtggagctgaaaggaggaacatttgtaactaagaaagtccataatgacctagcacatcttcccttttgctgacaatgttttaaatcttcccgaagtaacagctatgttccttttgatatgctaagtatgttattaattgtttttagcagaaaaaggggcacattttggactccttgggacatgagcattttcttctggttttgtaaccttacaattaaggaagccctttggccatcgacaagaaatctatgaactaggggctgaggggccaaaagcccagttatttgaagccaggagggtggctgtggccctgtggccctctgcctaagtaacggttccctttcttggggctggtaaagtcagacggttagatataaagaaggcacttcatcctgtctcccagctttcagattaagggatgtcattatctatgtttttttttttttttgaaaaatcattttttaaaactcattgcctgtcaatatttaaacaatggaaatactttaggaaatttctctttttggggttttaaatatgctgcaatggaatgccctaccttaatgaattaatatgtaatgtcttccctgttcccaagtgttcaaaagttgtctggtttttttttttttccaaccctcaggagctgtttcacaaacatggtaccaaatgcttgagattgtggttatcagccaagatacacattctctgggtgtaggcaaactagtcagctgtgctagttgtcctgatgaaccttaaatgcatgttacctggtagaataactctcattttgtttactaattaagtgacagaatagtgacagaaagtttaaaagtttaaatagtgacagaaagtttatagcatacccaaccttgggttttaaattgcaccaaattcttatgtcgttcttgtgtatgtaagtctggaggctctaataactgtggctaaatgggaccaattatttataccttttagatgatttttgaattcaggaaattgcattttgtattgcattaggttaatagattcatgaaagcagagaagaatcagtccatgagacagagaagtcctcatagaaaatcagtgttgccctgaaacgggctcagtatgggcaaaatagaagctaggataattggatccaaatccatttttagtgactatccatatactgagaggacatttcaaggacaaaaacaatgtatactcttgacattgaagactttctgtctgcaaaattatgtagattcaatttctttagcctttggcctttcaagtcgaaaaccaggtttggggtgtggagggggatcaggtcacttgccatattacacagccatcgattcccttcaccagctgctgctcagtgggccgcacaagcccgccagtcttttctcagggcagggatggaaaatgagagggtaggatgagaggaaagtaatccaactggattggcttcttaaaatacagaagatttgagtgagagtgaaactgaacattttgtgcttttgatgaccaccaaatgactacctactacttcaccacagctggagaaactaaaaacacatgctcttttgctgccgggtcagaaatgctttttttcccatatgaaagaggggctgtgttgcacgtaatctgtgcaacattatgaaaaatcttcatatacagacaaaatggtactagaattgaatctggactgcaggaagttcagtggcacataatttttcttttaataatctatatcgaaccctcctgacacccgatataatctaaaatggcattagttatacatcagtgacccaaaaaagatttgttttttttctaaatgcagcataccagtgaagttgctaattacattgaatcattctgtacacgttctattttgaagggaaaaaacactttctgatttttgtatgaaattgtatgaaagactacttttcagccgtgactcatgagctccgtctcattgcagctacttaggtatttattcccaaatgtctgacgacacctccaggtgcattagcatgtctattacacaagtgtcctattcattggctaaggctttgctccatctgttgaatgttctgaggaaagcattataccctttctttagaagccagtgtttatatgtggagtcactaatgtactggtaggttggatttagtgaagaacagatctgaaataacctgatttttttccatttgggttgttgttcattgtttacactgtacattacacccttcatggaaaacacatagaaaaatgctacctactcatgatattcacattctccttaaatattcatagtttgagcaactcaggcatgagggagaagatgaacaataggaagaaatacatgagaaaatacatgtaaaaacacaagcaagatttattaaatacaaatcgactgtaatgagaggtttatagtaaaaaagaaaaaagaaaaaaacaaatgttgtaatgttatattacttgtatgtgtacatgattaaattgaaagccaaaacttttaattaagatactgaggtttatttaggcacctctcagcatgttggatgtagttcaagaattttctgaaaaaggaagcttgtttattaagtgaaaatgatgtgtcttttgaagcaggcatagaaagtcaggctacccttttggaataaatgtctaaaattttatcacccagccacatttctaactgtattctaagcttgtaaaactttaatttagttaatttttaattaaattatttaataatgatgctttctgtcttagaaaatcaggggacatttatgtggacctaaggtgtaggttagacttcagcaccttacacgtcatataagatgatttttaaaatcaggaaatagtatgtcatattgcattaggttcataagtccatgaaagcagaggagaataggcccaagaaagaagtccttacagaaaggaaatcagtgtggtcctgaaatagggttggtatggacaaaatagaggctcagataattggatcagaagccactttcagtgactatccacataccaaagttttagaaacttagttgtggtaacatatctccatctgtcaatcaacaggcatatactgagtgattcctgtatacaaagccctggattaggtactggggccccctagtgtatgagcagaactttctgtcatagagaaaccccacttgttagcactagggaatgtatccaagtcactcggcaccaaagtatgttagcagcggggaatctgtgggtctgtagcaacctcatttcttgcctcctcaaggaagaacaaggcagagggagaagccaaggcaacttttagagcaggagtgaaagtttattaaaaacttttagagcaggaggccgggcacggtggctcatgcctgtaatgccagcactttgggaggctgaggcgggtggattacttgaggtcaggagttggagaccagcctggtcaacatgctgaaactctgtctctactaaaaatacaaaaattagccaggcttggtggtgcacgcatgtaatcccagctacttgggaggctgaggcaggagaattgcttgaacctgggaggcggaagttacagtgaacagagattgcaccattgcactgcagcctgggtgacaaagtgagactccgtctcaaaaaataaaataaagtttcagagcaggaatgaaagtaaagtacatttagaagatgaccaagcaggctacttgagagattcaaaaagtgcatggtttgacctttgacctgggcttttatatgttggcatgattcgggtgttatattacttctctcctgattcttcccttggggtgggctgtccgcatgcccagtggcctgccagcacttgggaagtgccgcatgcgtggtgtttactgaagttgtgtgcatgcttactttaagcgatttttcccttagcagtagagcattcccagaggtaggtcttataccagttaaacaccgcaattttgcctcttagtgcacatgcttgagcccaattacccacctcctgagatctcatggggacgtggctgagcatcagtttcaggtgtttctgtctattagggaccgtgtttccttggtgccagctgcaaccaattattattttagcgagagatagtttaacaaccatctgaccttcacctgatggccgcctgacattcctggttgggtggggggccctctcttgccctgctcatgtctaatacctactctggcatccctactatgtacagatgagggctacaccgagacattaaaattagtcaaagagctgcccgagggcaaacatgccctccacaaagacaagtggtaagggaagaagcatggtgatgatgtgtagcaattgtttccttcaatgatggctgacactcccattcccggataacagcaataggtcaaggcagacatatctagaagttctggaagattaaaggccttcacatttcatgtacttagaaatagctaaggggataaaaaattattccctaagaaataaatgcctaagtacatgtaattctgtaaggttgaagagagcccaaaagaagaggtaaaatgctggctgggcatggtggctcatgcctgcaatcccatcaagttgggaggccgaggtgggcagatcacttgaggtcaggagttcaagaccagcctgcccgacatggcgaaaccccgtctctactaaaaatacaaaaattagccaggcgtggtggcattcacctatagtcctagctactcaggaggctaaggtaggagaattgcttgaacccaggaggtggaggttgcagtgagccaggatagcaccactgcacttcagcctgggtgacagagcgagaccctgtctcaacaacaacaaagaggtaaaatgctatcttcatttttccctattctctcatttcaaacaaaagaaagtgcaagctgggatggacgcggtggctcatgcctgtaacccctgtaatctcaggtgcggtggctcacgcctgtaaaatgcactttgggaggccaaggcaggtggatcatgaggtcaggagatcgagaccatcctggccaacatggtgaaaccctgtctctactaaaaatacaaaaattagctgggtgtggtgtcacatgcctgtagttccagctactcgggaggctgaggcaggagaatcacttgaacccaggaggcagaggttacagtgatccaagattgcgccactgcactccagcctggtgacagagcgagactccgtctaaaataaaaaagaaagaaagaaagagcaagcttttctctcctcatgaagtcaaagcttgatagtagctcagactcagggagcccacactcaggatctttgcatgtgtgtctcagcattgtcatttataagctggctttttagagttgttttggtcttgtgcacatcagcacatcattcatattttatacaaaattgtgacgtgatcagtatctcctccaacttcatcctgagcacactgcgtgcatgagggtttgaaattgttttgtaacaaataatcataaatttagaagtacgtgacgtaagctaattcaggttgcccagagttccacttaatttgatttattgcaaaacaaatacgaaagttcatgaatttgacatagacattgttaacatactttaagtatttctagcctgtttacttattatgcaacaaatccaacattcctagaagtgcctattttatctagactaattgtttccacacacattaaaaggactcaagtgaattgtagaaatgtattctaaaagaatatgccctttgaaatgattctccatctggatacagactgcaggtttaagtatagagtggtggggaatctaaggtgtaaggtgaccctagagttttcaaactcagagtgaaaaaatcttgcctaaagctaggattcaaaaataccaagagatgaaactcttcttatgggtactattaacttggggttgattcatttaattttccttttgcttggtttaagaccatgtactataggaatgatacagtggccagtgacttcattgtctgacattttcaacaccctttgttacttctatcttcactggtgagctgtggattattttatcatctggatgcttagaactctgagcaagtcatgttctagaactatgagactaaacaatgaagaactttgcactggtaatatcaaagtactgaaagtgtgtggttttaaagtgtgaaaaacatggcagttaagatctctcaggtactttgaaccataatgcagttttccttctcttcaaaacctctacttctaaatggcattcattgtgttttctagtgttttttctttggtatgacactagttaacctgtatttcttaccataaagctaggactcaaatactaagaggtttgactcaccttaggtggaactttatatagtactttaacttagaaatatttggaatcaatttctgcttataaaggtatcaaaagcaagtgatactaaaacgagtaggttcaaagttgtatactaaatagagaccttggtaagagagaatgagggattttcaaatatggtccagaagatagtctctgaaaggctaaaccagcaatggttactagccatgcaggaagccagtgctgtctaatcttacaaattctgttttcctgccaaatggcatttaggagcaactgataatttatttcttgccacttgccgttactggagatttatttggtttctcaactcagcccttaacaagaaagcaagtctttgttgagggcacaatattatcagtatggcaaagctaagacgaggcttctgtgtgacactggaaagaccaacaagaatggattaaagagagtgattttccatatgctgtcactgggacaggtacttttctctgtagacacacaggctaaaagcagtttaaaagcttccttacctaaacagtacatagttcaaggagataggccctgtgtccattgcgtctctagtttttgtttctaacccattatataaagaaacatcccagtttgctttttagagaaaagttcaagttagaaccattctctggtcttgctaagtctcttaattgtgacacaactgtcctaagcaactgtccttgcacaagaatgtcactcatctgcttcatctgccagctccttagagatgaggggggtctgtgtgtcagcaggaggcagaaggccctgtggctcatccagtggcctgatttcctttgtttggaggcttggttctgagtgagagttcaacagcctttgcccaggcggcttctcaaacacagggtgtggtttccttagctcactctctgctgtttggttgctcatggcaacaagatccaaataacttggacatgtgtttgtataaaaaaaacctgggaatggaacccaaagtgagactttggggctttcagttagtggaagagctgcggtgagtaccaggcaactgctcatttattttctctcattctttctctctaaattacgctggaagtttgctagcacaataaccatgtttgtggatagttttagaaagtagtctcaattcttgtatttcctgcacaaatgaaataattgctatctatttacccgtgcaaatttctttttcgggggagaggaacaaattagcatatgtttaaagaagttgaaagctaatagaaactcatatttggtaccttttgggtggcaggattctataggaaatgccttggcaaagggagctgcagagtgccttagtaatgcttgggattgcaggcgtgttgtctagggccacagccggggaggggaccagggagggaagaggggttgttcatacggagggagtggaagggattcttggaataattttttccagactctattttaagattataatttttaagacagcaaatatcccaaatggtaatactggttacacttctatgagcatattgattctcacttgcttgactcaagggagggtttgattttggtcacaaagccacccgtgactatgacagataattcaaggttgccaaacttgcctgtgccaattgacaaagccatttatataagtcctctcttgctatattgctctggcctcaaaaggcagtaaactctcttggacaaaactctttaggatctattcagggatttaacacttttctgctaaattgcaagtaaatttaaacattttaaacaaattaacaaggattgcttaggtacctggtgtggtacagaatgagctgtcagtttctattctgatgaatagaattttatagataggaggaacgggaggcctccagaggatactaccctccctaaaaagagacggaggaagagctgaaagcgggcagagaggcttcttgatgacaacgtggtgggcttagagaagctgctgcctgcaggcggggcccctgctttcctgcacccctttgagcctctgccccacactcttcctttgtataaaacaactgcttcttgcctgcctgccccatcacacccctccactccatcgggtcactgctcaatggcacaatagcactgctcagccatacctcccagcatcctgtcccctatctggtgacttggccaacacaggctctgatccacttgccccgctccgcatcttttgtgaatcagcacagttgatatatctgagcaggggcttctaccatctccccagggaatcactagccatcggccatctggccccgcggggtgcttttgttcctggaatcatagtgaagtatctgttgtcttggtgcctggtagtcagctcggctgaaggggaagctgggtcttggtcctcagaccccatggactccaaggcagcattgtgcaggtgcctctgggagccactgctcagggtgctggggcatttcctgtggtcatttgtcctgtctgcttgcccccgcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggtaacgggcatccccatgtgccaatgggaagggctgggttttggagtgtcctttgcccacaaccatggcagcagcagctggctgttaggatttcccagcatcactgcagccaccttgaggcctcaaggaagcctcctccactccccaggccacagtggcccgagctgtttaatgtggggcttgactggatgggcgccagcgcccttgccagctcttttgattgcattctaaatatttcaagaattgtgagatttttatcctcacctcagcgtccctcctataagaatagtcactgtggggcagtcccaggtgtaagggactgtgtcatctcagtggtcagtcccagggaaatcagccttatgggagggctcctgccaccacccccagcacccctcatggtggcccaccctgtctgcttggtttccaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggtactgcctccttcccaccccgggttcccagggaggaggccctgagggcagacgtgatgtgggcttgcttatcatggtggggctaacgttgctctgagctgctttgagatcttagcatatatatgtacacatatacatacacgtatatatgcgtacacatatatgctcgcacacacgcacacactcggagactaaagaacactggcgagaacagcctgtggcaacagaatgaagtgaacagtatgtagcgctttctcatttgggcgtagtaagtgatgaaagcatgcttcttcctcagggtgtcattctgggccaggcagtccctgatttaatgtctaagtgcacgcagggtatagaggtgggggagtgggggattcaggcactggatcctaaaataataatgctggggtccccacccatgacagaaatcctgggttggcacaagcacaagtagaacacaggtaggttagttggaggtgtgaggccagtaactgcagggcctgcatcccctcacctctggagggcctggggaggggagctgagtggatgcagccccctgcagagcctgtcagtggggctatccaattgcttccctctgcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggtatgctttcaagggagttctgcattgaccgttgtttctagaagtgtttgacagtttgcagagcacttccacacacactatcccattccatcctcacgacagccctgtgacgtaggaattattattcccgttttacagatgaggagatcgtggattaggaagcagtgccacagccaagtcaggctgtcagtacgcatcctcagcctggtggtgcgggtggcccgtatggcatgctgagctgggcagccctggctctagaagcctgcctccaccacttaggggctgtgtaacctcacataggggctcaccttctccgagccttggtgtcttcatctgtaaagtggggataataatagcccctgcctcccatggctgttgtggagattaaatgagatattgtataccaaagcgcccagcacagtgcctggcacgcagtaggcattcaacaaaatggttgttgaatctgaatccggtgctacactccctggtctaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactggtaggctaaagagtcc

SEQ ID NO: 1007 - DNA, 11385 bp, mus musculus
tgtgcaagttgagaggataatgtcattgcctctgttttatttaaccttttagagtttattggaaccattttaattgtgcatagaattaaacattgatgtactcctaactgagactgtcaaaataagagagaggaattctacttagtttcattcatgcttttacttttgtttttgagggagaattttaattcattaagaaacctctgtcctcacaggagtctagtaaaagccctaaaacgatgaagaaatttcttcataaaaggaagactgagagaaaaccatcggaggaggaatatgtgattaggaaaagtatgtgttttgtactttctgaaagttgtttatggataaattaacatgagaatcttcttttatgtgaggatttatttgaaagcagatgattggagcaattttttcttgacatcgtcttttacatataaagaagaatgcatggaaagctttggtcacttcttaaacatttgaataagcttcttacggctgcacttcatgtcatcttaggcagatgtcatctgtatcatttttgtgttgagtattttgcctcacctggtttagaacctctaaagggacccatttcctatggatacattttttccctcttagtttctgatacttgagatatttttctgcagggagatagactaaatagacccgaaggctgaagtccttccagaagtcccatgctcagtgatgctctcagttactcagggaatcagcctgcccacatctagaaacatagtttcatttggagacagactgcaaagtcagtcagccagtcgatatggacatatttggctataaggctgtgaacaaggtactttgggacacaaggtactttgggacacatgtgaaggagtaagtgatgtctcacaaagaggtgacagaattgtgtgtatcagctgggaatatagtttggataaatatttgctccacttcagctttggcatgccccaccccccaccccacacctggttatgcacactggcgtgttcacagggtgctgccatccagccattgcaagaatgagtttggagtagaggagaagggagaagggaaaatgagtgactatgctgactggttagaaaattgggtggggttggccgggcacggtggctcatgcctgtaatcccagcactttgggaggctgaggcgggcagatcacaaggtcaggagatcgagaccatcctggctaacatggtgaaacctcgtctctactaaaaaaaatacaaaaaaaattagccgggtgtggtggcgggtgcctgtagtcccaacaactcgggaggctgaggcaggagaatggcgtgaacccgggaggcggagcttgcagtgagccgagatcgcgccactgcactccagcctgggcaagagtgtaagactccgtctcaaaaaaaagaaaagaaaagaaaagaaaattgagtggggttaatgagggaaagcttcctaaaggtgagccttgaaatttaaaggagaggaaggctggggtatattgatgggagctaagctagcaacaagctcagtgctgtgattttggcctcactgagaccactgacaaaacaccgccccccccaccccggtcccagtgtagagctctgggcttcaggagtaggccctccactaagctgagctcactgaggctgactccaaagctccatgaggatgctgtcactcttctccatcaccagcgttggacagctctttctcctgcctttcacaaactctactggtcagagaagccagtcccaggcagtggagtgtgctgcatcattttgagggtccaaaagcatatatctatgaaaagtcatgatgaattaaatttcacaggtacagctgctctggaagaggatgctcaaatccttaaagtgatcgaagcctactgcaccagcgcaaattttcaacaaggccatggctcaagtaggttcccccaaactactttctctagtgagtgacgtttcttccttactgtttagtgtcttttagaaaaagagaaaagcaacccggatgggttgcagggtgtggaaagcaggtgacttggtgcagaggagtggtgcaggactgcatctttcagataaggtggttttagctaccaagcggtttgtttacccactgttgtttttcacccagaaagagagatgcaagagtaaaagagttggaggtgatagaagtgaaaatttttttttaaagttgttctcctttgaagtacacagataccttcaccaacactagttaggaattaaagggcctagagagttcctgtgtctgtgaactgatgctaatctcttcttataggcagatttggaaaggaagtcaaaatactatctttgatcagctgcatatttaaacgaacaatgcttcaccaaactcaagtttcaaagttgctctgaaaatctggaaaggtagctgcttagcagaggttgtccaaaatgtataaagttgatcagggagttattaggttagggtatttccccaaacaactttcaggttacaaactgaaagcaagataatattttctgattcatctttatgcttttaaaaagacaggtcacttcgattatgtcttttgtctcccattattatagacattcagaataccttttgtgaagtttttgcacctgcataagaaatgaatactccatagtactccattttggacatccagtgaccaatcatttgaatgtgggaggggatttcttaggtgccttgacatattctttcaaagtaatgcatctctaaggctgacataaaagaagcattctactgggcatgatggctcacgcctgtaatccagcactttgggaggccaaagcaggcagatcccttgaggccaggagttcaagaccagcctgggcaatatgggaaaaccctgtctctactaaaaacacaaaagttagccgggtgtgatggcgcacacctgtagtcccagctacttgggaggctgaggcaggagaatctcttgaacccgggaggtggaggttgcagtgagccaagattgcaccactgcactccagcctgggtgacagagtgagacaccatcaaaaataaataaatacaagagaacgagaggtggggggagagagagagagagaaagagagagagaaagaaagcattcaatgattcaatgtgaaagttgacgcatttggccatgaagagaggactgtcgcactctgcttcacagagaaaacctggctgtggctttgggcatgcatagctctgataacatgtttcaaggagccaggagaggaaagtgagggcagctttagttttgagaactagagaagagagggggacaaagagataccagaagcatcccttctacaaaatctgacctcatctcctcccgcaccacctatttttatatttgacagagtggatgggtctgcagctgggaagtgcagccagatattctggcttaaaaagacacgtcttcacccttgctccctacccaaccttttacatgtggaagatgtctggcactgtgcttgtcacacagcagatcatttagcatcgtggtgaccttctatcctctatccctctctaaccagaagccctgtttctctagaactgactgccctcggctcttactgcattcagccagtcattcagtcagtttgctttccacttatattcgtcccttggtatctgcaggggattggctccaggacccccagagataacaaaatctgacgatgctcaagtccctgatgtaaaatggtggagcatttgcttatcacctccatatatcttcccatatactttaaatcatctctagattgcttatcatacctcataaatgtaaatgctgtgtaaatagttgttatactgcattgggttttaaatttgtattgttttttgttttttctgaacattttcaatgcacggttggttgaatccacagatgtgaaacatgtggatatggggggccacctgtattaagcacctacaaagtgctaggccctggagaaggcagagacacatcttacctcaagaaaggggaggtggtcaagtgaaggcagtgagtgtgcacacctctgaaggaacttggcctagaagagaggaagccagtggctcagggagacccaagattaagcacttgagctctgagagggaggatccagagtgagggaggtgcaggagagctgtttggttgggcccccatgcctgttctgtcacctcttctgtcccagagcctggagacattctgggcagaggacacctacatctttgctgatgatgtgataatctccaaacctcactccacccttgatgaaaatggtcttaggagacatacctaccttaccctataagactgtaaagagaacaaatgggggtgatgatgcttctgaggccctttaagcacattgtgtttcagtgcagtgctactgtcaaccttttactacaatgacaaaacactgtagcataggatgtagtgtgtccttccttggagatttgcagggaagagtgatcactggtcagctctttgctctggaggaggcaaaacaggaaagaatggaggtcttggttgtggacaggtattacaggggctcttttgcattatttttctgaatacaaaatgcttcccacctcgggaagattgaatcagtgtatttggccatttagaatttctcatgtcaggaaaatttagtcagcaaatgatgggtgactgtcctctgggtgtaatgtagcaacatgctatgaacaaagacccttctgtaacaatagtggaaaagaactaacacccactatttctactcttcactagtaactctccctcctcccccatcttgcaacccttgtttgtaggtactcgaaaagattccattccacaagtcctactccctgaggaagagaaactcatcattgaagaaaccagaagcaacggccagaccatcatggaagaaaagtgagtagagcaggcaaaaccttgcctagtttctcttggggctggcaagaaggtctggtaggacggggagctcctggagagtctatgatgagggacaactcctccttacctgggaatgcggcctgctttgctgtgcatgcatttgggagactttagagggctgcccactaacaaatggaaagaggaaggaaaagcagcggtgacagagccctccaaggcagctccagctggcagctgcccctgcagccagctccccatccagtaagctgcttctgagcacatgggaatatcaatgccctggatgggtttaggaagtggctgggaattccagccacagaaccaatttccttgcccggagagatgccactcacatgttttgagtcagaagctgtgctttcacatttttgacatcatttaaaatcctacagcaatccggttagataaacattactctcaccactttcacagataaagaaactgaggtacaggaagttcagggaaattatgtctctgacttacctttacacagtagtgtgggtgacctaatgggggaaaatcaggttaagtaccttctggctcataaaattaacacaaagtagccaaataattcatttgtctaaacttgagtcatttctgaagtcaggcctaaatttgcataggacagcatatttcaaggtgcttggcattgtcaatgcattttacatctgatgtgtgaagtgatacagcaaaatggttaagtacttgggctcaagcaaaaaacagtgtggttcaactcccacttctgctactcattagctgtgtgacctggggcaagttgcttcacctctctgtgcctcagtttcctcatctgtaaaataaggatgacggtaatgctttcagagttgttgtgaggttaagtgaaataagtataaaggctagctcaataaataatgttagttaattcttattataacgatattcatttttacaactttgtgaggttttcagaaaatgtgctattatccccattttacatgtaaagaaactaagaccaagagaggatgagaaggaaactggttcccagagaacagaggactagtaagtggcaggatcagaaccaaaacttagatctccaaaatctttgtccagggagagacccagagaggaaaaggctgttctgcaacccagtaattaccaaaaaattacttttttgggtactgtatggttgagatattccagaaagaatgcctctgactttgtgtcatgtgcagtcagagaactgggaagggcaatgtcatagcacagatactgtagactaggcaatcttgtgatacctctcattatatgataggtgatgttcattcctgccccaaagctagagaaatcaaaaccttatgacgggaattgaaaacgtcgaactcctaaaaacagagagcagaatggtagtttctagggactgaggggaaaggggaaatggggagatgttggtcaaagggtaccaaatctcaggtatgcaggatgaataagttctggagaactaatgtacagcatgttgactacagttggccctctgcatgcgtgggctctgcatctgtggattcaaccaaccccagatcaaaaagatattcagaaaaaaatggatggttgcatctgtattgaacatgtacagatttttttcatacctagtaaagtttttctttttccgcctttgttgagggataattgacaaaggtgtacaatgtgatgtcttgatatatgtatgcactgttataccatattgttttttcctaagaaatatggtataacaaatatttgcatagcatttacattgtattaggtatgataagtaatctagatatgatttaaagtgtatgggaagatgtgcattggttatatgcaaatactatgccattttatgttaaggacttgagcatctgtggattttggtatccatgggggtccttgaaccaataccccatggataccgagggagggaagactgcatagtttacaatggagtatacttgaagtttgctaagagtgtagatttccaccacacacatacaaaaggtaactatgtgaggagatggatatgttaattagcttgattatggtaaccacttcacaatgtatacatatatcaagacatcacattgtacagctttgtcaattatccctcaacaaagctagaaaaagaaaaacttagtgacgggccctagtctcttgtgttttgttcacccaagctgggaagtgagtagaaaaggaggagggaagtatagaaaaggtgtaatgacattgcatttagctaagcatgtgtggtggtggttgttcttccatcaaagtcaagaagatggaaaccatttagagcagtaccattcccaatcagctagaaagtccactgtttttcaggatctgtatttttataaagtggcttttattgttaagtattttaacagtacctcagtgcaagccatttgtctctgaattttatctttattttctaggagccttgttgatactgtttacgccttgaaggacgaggtcagagaactgaagcaggtaataaaatataaaatcattttctcgggtaatagaaccattctctttttcttgcctcacgctgctcatgctttcagggaaggcctaggagcaaggtagcgaggggggatttttgttttccttgtgtcatcaaggtaggttttgttgattttatcatgtaagccttgaatttaaatttccgaggcttgcttgtatttctatgtagtagttcacaatagagtcccaaagttagttacaactttcctgttctctgacatccataaacagactttaagaaaagactagtcattcatgagtgtgtaagtgtaaagagaaccattcatcatggtttgtgggcttttctgccgatgtggcctagtgctccgtgatgcacactgtgccttgtgtgtgaggactgactgtatctggtgacagagtgaaggatggatgcgaggggagagagaccagggactagaagaccacttaggaggttcttacaaaactcagggtgaaacctgtcagagtcctgaactgaggcagggtaatgaggctggggaggaggaaacgaatgtaaaggatggcatactgcagagtttgaacctatggacgaggataatatgattttgagattaagaaagagccagggattaaagatgaagcttcttcccagggtgtctggttgcatatggtggtgccccttcatggagatcagtaatcacaggaggaggagaagtttggggtgttgagagagatactgagttcactttaggacctgatgagtttaaggtgcttgtgacatatctaggtggaaataccaagctgctgccaggtaatctcaggtaagtgagaggatcacttaagcccgggagtttgaggctgcagtgagccatgattacactgcactccagcctggcaatagagtgagaccccatctcttaaataaaataataataataataataataataagaagaagaagaagaagaagaaataccaggctgacagttgagattgtggacccgattctcaggagacaaggtcagtaccagagatatttgggagtccccttaatagacacttgggttgaaacagaagtgacactaagtgaaaagcaagttaaattagaagaggatcagggcagggaagaagaatccaaaaggtttcccagagacaggcaggagaatcgacaggctgctttgtcatagatgctgagggagggaaggtcgaggaaagaaagagagtcagtgatgaaagctgccccgaggatgagcaggaggagcccttggaagggcccccctctgtttgataatcaacaaatctttccccatcataggaaaataaaagaatgaagcaatgcctggaagaagaactgaaatcaagaagggacctagaaaagctggtgcggaggcttttgaagcaaacagatgagtgtattcgaggcgagtccagtagcaagacctcaattcttccataaccatcactgtgccactgggtggagtgtgccttcagggcatcttgaaatgtcccgctgaatgatttgactcagtttgctcacttctttggcttttgttttgtgtttgagtctctctctctctctccctctctcttctctttctctccccgctgtgtgcatatgtgtgtgcgtgcacgtgcgcgcttgggcatttgctgttgtttggttattggttggttgttcattttttttttcaacaggtgaaaaagcaggaagtggtggtagagatggcctcagagtcttttccattcagtaagaaagagaaagggaatgcaggccagttacttaaaaggtcttcagattgccttcagttcacagtgcctctgcaacagccattgccctcaggtcacattctttgggctggctgcccttgcaaagcagctggccaaggcttattaaatgtgaacccaacttttccccagggctttcctgtacctgcaagcctcttagtacttaatttaccgaaggcaaatcttccagactatggcttgagtaggatgaaagacaaacacatctgcccaatgatccagctgcccttccttagaccatcacatgcctcccctcaatcacaggttttaaaattactgccctatgttgtctataagaccaagaaaactgtagtacccttattccttttgtgtcatgtaaattgtaactcaggggggcagaagctctggtcacccacaccaacaccaaatccatcagcaaattctactggacaatcctcccttttagtagcagagttgaccgccttttcccattgcatgataggtttctttccctcattctgcctagtgtgtaagttttctatttccccagtacttttagccaaccttaccaagtggtgtgtaaactagtatgtatgtgctttgcttactttttaaaaaaatgtagttagactgtgaggagttactttatgtacgttgcatattcaaactgtgatgttttatccttcaaaacaatctgcattaagaagatattgtgccctactagacagctttcattcactttattactctctcatatatgctgtgagaagttgtaatattaattggcctctttgggtgggactctaagcagtatttgcagaaatatgcttctggtccaacttgtacatccagaacaaaagggcccctctagtagctgtgtgctggattattcaggactgattaactcaagttgctcattgaatcacatcatccactttatcccagaaactagaactgtgagaaaccaggtttagaagacagtcacagaacagcacacatccaaattcagcgccattgaaagttggcctaaggctcagtgccactcacccctccctccccaaaagacaagagaaatttggccagatggggaaggtcactggaaattgaggccaaagggctgatcagaattgcctttataatatatttgatggatgcctataaatgtgggttttgcaaatattgtttaaaaaccaaacttgaagccaggcatggtggcccacacctgtggtcccagctactcaggaggctgaggtgggaggatcatttgagcccaggaggtcaaggctgcagtgagctgtgatgacaccactgcactccaacctaggtaacagagagacacctctgtctctgaaaaaacaaaacttgaagtttgaaacccccagcttgctgaggagccctttttatttttggtactgagagtctcaaggtcccatagctacatggtacagggctgttgtctgcttgctgcacagcagaaattacaccatccacaggaaatggactatttttgcagtccaacatcagccaaccacacacagccgtgtttggaagctgaagagtaaagaaatttctaggaatggctgttgttctgttttttagcacagccatttagatataacatccttcacttaaaaattaaaaacatcagtactaccaccaccaccaacaacatcaacacagatcttcacatctgcccattctgtggttagtcaatggcttgcaataaatgtgcaaactgcatctataggaaacatttttgtgattacggaatactttagttgattgctgaaaatattgaaaggtcttcattttacagtgatgagtacatatgcatgtttcggggacttggcccttctgatgaggggccctcggtactctggataacgaagcttgtgcagagtggtaaccatgcttacacactaaactataatataaaggaaatgaagccatgttaatctgagagcagtgtcgccatagttgtgttgtttacaatactctataaatgggttcctgttgccctgtaattaaactgctgcccgtagaggcctttcagttccttttctgtccttccccttcttaacacaagctcaaattttctaacttgtttttattttgaagacttttaaaatggacattttcaatacataaaaataaacagtgctttataaaaata

SEQ ID NO: 1008 - DNA, 53 bp, mus musculus
aggtagagcgggggagggggttgttggggttggggtttgcaccacgcaggcac

SEQ ID NO: 1009 - DNA, 53 bp, mus musculus; identical to SEQ ID NO: 1008

SEQ ID NO: 1010 - DNA, 448 bp, mus musculus; identical to SEQ ID NO: 984

SEQ ID NO: 1011 - DNA, 248 bp, mus musculus
gccgccccgcctcactcgcggcccgcccccggcctgcctgacccgggggcggcggccccgcggatcgcccttatctggccccggcaccccgggccggcagctcgcgcagcacccactgagaaggcgagcccgccgcgcgggggaaggatggcggaggagcgcgaggctcctcctgtggggagggggcgcccccgtctctccgccagcgccgggctcggcaccccgcgggatgcgctcttccccgacgc

SEQ ID NO: 1012 - DNA, 117 bp, mus musculus
ggcccgccctgagccagccgacggccagactccctcttccgggcgtggtggagccgggctctgaggcagggcaccgtgaagaccccagcgcgggaggggcggggcggggtgcgaggg

SEQ ID NO: 1013 - DNA, 822 bp, mus musculus
atggaggagcagcagaaggagggcgaggccgaggtcgcggagcactggttttccaagtgggagcgccagtgcctggctgaggccgagcaggaggagcagctgccccccgagctgcaggaggaggcggctgcagagttggcagggctcaagagcgagaagcagaagctgtggcacctcttccagatctcggccaccgccgttgctcagctttacaaggattctgggtgccaacagcaaggactttccatgtgggaccccttccagaatgcggccatggccgtgaccagcctctacaaagagagcggggatgcccaccaacgaagttttgacttgggtgtccaggttggccaccagcgtcgcatcaaagatgtgctggagtgggtgaaaaagggccggagcaccattcgtcgcgaagacttgattagcttcctgtgtggcaaagtgccccccgctcctcctccacctcgcactcctaggacacccccgaagccacccactggggtcaccagccaggctgtggcaactgagtccagctcatcggtggacgtcgacctgcagcccttccaggaggcgatcgccctgcatggcctcagtggtgctatggccggcatcagcatgcgatcgggcgactcgcctcaagacagcggtgtcgccagcagtgggcgccgaaaaactagcttcttggaggacgacttgaatcccttcgactcagaggaactggccctccacctggacagtggggggatccgcaagcgcacctcggcccaatgcagtgatggcatcacagactccccaatccaaaagcgcaaccgaatggtctaa

SEQ ID NO: 1014 - DNA, 822 bp, mus musculus; identical to SEQ ID NO: 1013

SEQ ID NO: 1015 - DNA, 5036 bp, mus musculus
cgtggtaagagttacttaggaggcgggagtccacgaggcccactcagaggccaccaattagggtttcaaaaagtttgaaagaacgaaacctgaggaggtgacggggggaggggggagggggcacgcaagcagattggggggagggggcagaggggcgccttcggaatttagaaaacaactttgcaaccctgtcaaggcagaccggcgccccatcccccggccagcccgcaaagcttcccgttgtctgcacggaggttttctggccgcttctgctgccagcgctaggaacgcagggcaccaccagctacccaggccggcttagggactccaggctcattggaagtgctcctggctgcgtctccaagaagctctccctggaattggccgctggttgtccagatctttctctaggagggccagtgcgtccaggacgcagcgtgggtcaggggcccgggcatgggagacaggcttcaggactgcggggtgcattcggctgtgaggctcttgggggtttgcaggagggcgggcaagcagtcagtcgcccgtctcctgagcctgtcggaggcgctcgcacaaggtggtgtggaaagtatgtgtgggacgtagggggtgaactggcctccgctctctcgatcctggcccccgcttagcggcccctttttgtctctgctctgtggccatttcggtttttccagtccgatgcccctgagggggagggtcgggccccttggaaaatccgttttcatggcaacacggagcctctcagagtgaaagaaaagtttcttggaggggggaacgttggccggagcggagccgaggccgtcctccgggcgaaccgccgggccccctccactgcccccgcacctgccgggaccgctgagcgctactctgggcgcgcagcctcgccgcctcccccgggagcaggctctgctaacggattccgtccgtctcttttattgttttagagacttcctgagattcggagcgggacattcacttgcttgttgggttatctgccaaagactagcggcgcgggaactctggctgcggggagaggaaaccccgataatcgccactgccagctgaagcgagtggcacagcgtttgaaactctcggagcagcccgaggtagcgagtgggaatgagaagccatcccggcagatttggcagaaactaaaataaggtgtccatacggtgtggggtctcgcccccccatcatccctagccccgtggaaaggtggggaactaaacggaaagcataatcttaagtgggtggggggcgcatgggggaatcccaggtttctagcgtcttagcgttaatgcaagaccaggcgatcccgggacttctgcatgctgggctcttccccctttctctccacgaattaaaaagtacgcctcttcggcttgttagtggggtcagggggggagtggaggctcagggcaggccagccccctctcggccaggcggacctctggcaaaagaatcccggctcccagtcggcatcatctctcggaagtttggggtctggaaacttgccccttaagtttgtgttccacttgatctgagtattctgcagccaagggctgcagtcaactggatgggtatacggatttagggttttaaatgtaagtaaactctctggaaggcttctgtgtgtagatacagtgtgtgtgtgtgtgtgtgtgtgtgtgtgtgtgtgcgcgcgcgcgcgcgcgcgcgtagcgaacgtgagctgataagtacgtctcagaaaacataatgattaggcaatccctacctgcacctgttttcttggcgaagtggccgacaaggtcaaactttcttaggcaaatccatcctctcctacagaagccaatgtgcaatatctctgccctcctgccgtctttcccgcatgccctctctgggcttttctgggccctggaggctgttgctaagtgaagcgcgttttaggaaactacccaaccgacgcgcggcctggcgtccagtagcttcacagatgtcaggtttctttccaagttttaggacccaagtaaacgttgcagtgacagcgcctgggctgcatatttcccaaggcaggggatacggtgctgggccgacaccctccccgcagcagattaccaggggaaactagtcactgctcccagctgtctgacatttgatcacacttagcccgaggcttaggtgagctcatttttgccctacatcctcctgccagatttacagcagtcttttgccaggaccaggcacactctcccaattctcccggcttctcgctgaggccagctccctctcggggggtagatacataaaatctccgtatctggtggttctggggtgatctgcacattctcaagtaagagccacgccagatttccttggaaactcttgccaggacactttctaaatacaagctatcatttcaatagacaagcaaggttaccattgcgggcgtggggagatgggggaaggctggaaataaatcagttcttagcccacctgcagcgcaggcttagccaccagcccagcggcgcaaccttcgctaagggtcgggagaggtgtcgcgacaggtaccacagcgcaggaggcctcggttccggctggggctgcgggaaggcagggcagctggcggagccccaactccagtgtctccgacgcgcaccctgcacccagcgaggaaagcagaggaacgcagtgggaaccaggaccgatccttcaacctcttcaggagaagagagcgcgctcagcagctctctcgccctctccagcctccaagtgcccttgggcggttcacagagctccggatctggcgctgggaacccgaccaaggcctcctccccattcccccgcccttcctagagagctcccgctccctccgactggagccagccctggggctcccagaacccagggcgcgacaatagcgccgtttgttggcttcggttggaaacttcacccagcgtagcctcttgccgcttcgccctgcggggcttggaggtcgccccaaccttcgaaagagaccaagcggatttgcggcggagcagatgtgatgcctatccttagagggcgggttatagcaaaactccgggaccaagactctagcgtgactggcccaatgggctttgggtacatagggcacccctgctctgccttcttcctatttctaggcttggccgacatcaggtgtcccaagtgccttatatctgcaaagaacactcagcaattgtgccttagagctactggtggaaagagcaggaaaggagctgtcccacgactcgcgcggaggtatctgcattgattcctcttcagtaactgctcataggggacctttttcaaggtccctggcatgattaggacccaacttattagaagaggtgccctcagccgggcgcggtggctcaagcctgtaataccagcactttgggaggccgaggcgggtggattacctaaggtcaggagctcgagaccagactggcctacatggcgaaaccccgtctctactaaaagtacaaaaattagcctggcttggtggcgtgcgcctgtaatcccagctactcaggaggctgaggcaggagaatcccttgaacccgggaggcggaggttgcagtgagccgagattgcgccactgcactccagccagggcgacaagagcgagagactccgtctcaaaaaaaaaaaaaaaaaagaaaagaaaagaaggagaagaagaagaagggtgtcctctgcgtgctgggtggtttggggccgatgtgtgtctgtgtcgcttgggggacggagagtcggagagtggggtggggtgggcggtatttgggctcgcctgggcccgctgaagcctgacaatagggtcagcaaaggttgccctccggctgtggcctagcgttcgcctttcaggtttctcaagtgtagccaagcccagctcggggtctggcttttaggaagtgagaacaacttatcctggggactctcggagacgccttgattttcaacagacaaacaaaaccaaaaacaaacccgcaacagtttgcgtttcttaaagcagtcatttctatcttttcccttgagaacaccccttgtctgtttactctggcttctagccaagattgtgtatttaggccgctgatcgagagccttgatcaaaaaatcataggcttaggtctattgtagaaccatcccttgtaaaaaaaaaaaaaaaaaaaggtcagaaaggtcaccatcatttcaacggggtggtagagacagcaccttccagttcctggagcattcagtaggaaccccagccccactccgccaacgcgtagcaccgtctccagcggaagtactctttcttacaggtcacagaagcagctgaagaccctaggctggtgggtgtagattgtaataacttagtcgatggtctctaaagaaaggttgctaggagctgcgaggtatgggaaaacaaggtcctcgaggtaccataaagtctcctgcgggctgtacaactgtattctatcgtagtttggtgttgctcttttttgggagggtgcgggggtacttttaaaaaagtttccgcattcaattcacttggttggctgagctgtacttggaaaatacactgggagtcccctcggcccacacgttggcgctcagtttccttccacccacagagtattcaggtgttaatcaccagctctcttttccctatgtgcgcagcaactccaaggaatttgacaacctttgccttctgcttttactcgctgacctcaccacccgaaagttgccattttcccggaggaaggaaggctctgcccatgcactgggtcccatttccagcgggctttgctgagccatcgctgtcagcctctttgcctctcacccccctcctacacccgtctttgcccatccccacaactctcctcacgcgctcagctccgcagactgccaaacccccacccctgcggagcaactcggggaactcggccccctacgtccaggcctgccctcccactgggcctgttgccctttccacttccttttgtgactgcagaggcacagcgctcacc

SEQ ID NO: 1016 - DNA, 5036 bp, mus musculus; identical to SEQ ID NO: 1015

SEQ ID NO: 1017 - DNA, 69572 bp, mus musculus
accggctccgccgccggctccgccgctgctctccgaggcttcgccagaacccataccagagccctgtccagagcttgctccaggtccctgtccagaggcgacctcagaatcagccacagaactgtacacagaaccgaccccagaaccagccacagagccggcctcagaaccggccccagaacctgccacagagccggccccagaacctgccacagagccggccccagaaccggccccagaacctgccacagagtctgccccagagccgactccagaacctgccctagagtcggtcccagagccggccccagagctgactccagaagttgccccagagctggccccagagccgaccccagaacctgtgacagagctggccccagagttctgccctgaggcggctccagagttccgtccaagtccagcaccatgtctattgcaatgtccggtggacactcgagagagaggtctaaagacctcgccatcgccatcgccatcgccatcgcccagaacgccaatgtcgtggtccagaataaaggtaagcaaaagaccccctgaagcggggaaaagaagcaaggcgaagtcagatggctatggagcccgcgggactccgggtaccccttgcatcccgcttgtctggcactggctggccaagatgctgagaaagatgcagggatggggaacccgggggaatgggaaggggttgggaggcgggaagcaacatgtgggaatcgagaatgggctgtttggggctagaaacgggggtgacagcagggggtgggaatcggagcagttttccccttgaagagaagcgacagtgcggtgagcgccaatatcttgaaagagaggaggaagataccctcggggagcgcaagagacctggagaagtgtttggggctggccccgaatacatagcggacggattgagtgggggcggtgggacacacctcttagccgcggtcactgccgcagaggcccaagctgcggagccttcgcctgcttggccccctccctgccactggggagggggcgcctcagctgggcgcaactggcggccctccagggaggtgcccggcgcctctgccggctgcttcgagctggtactcctggtgaggacgaggggatgggcggcgcccacgcgcactgcaggggaagggcagggttctccgggaggagggggagagcatgcgtgtgtcgaagccaccattccatctgtctgcaggatttcccagcaggtaggtgcaaacgcagtgatacaatgttgcgcagcgtcacaaacggggcaactggcatcccgcaccagggccaattggaatggtacaggagtcctggtttagagacacgaaaataggagttgggattgcagaacgtgtgaaggggaaccttcatctctaccagtctaccgcgacgccttctaaatcgttacacttagccgggaaaagatgagtggagaatcttctggcactcgcccaaggggagtagggaggaaaaaggttttcgtgtttaccttggaccctgaaaccccgtctgctcttaagcgggagtatgcctgtctttcctgctttctctgcactctccctactcttcctttaccctaaacttcgttccacaaaactgaaaaccaggataatgcacacacacacctcaatttagcttcccctgcaggaagacatacacacgcgcgcgcattcacacacacacacacacacacacaaacgaataacacaacacacgaacaataccggtccatcctgctgcctagcagaccataaggacacggctcaggaacccttctgctgtggaccgcacacttatagaatgtagaatgcgggaggggagggggcagattggcatcacgaaatggaagcattggttgcttcctgagttcttagtagggaggcttgagtttgcaaaatatctgcaatgacgaataactgaaaaagaaggctaaaatgaaaagtttcacagagaaaagaaagtgcagaggtttaaaaataaataaaacatgacggtgggagactctgataagtttttaaaaattcaacaccctagctctcaccaggggatgtatccctccccttcctgaaaataccctttcctgcagtgatcttaagaagggcaaagttggggtggctagatttgggagctcaccctcaccgggtgattgatcttgtctttttggaagagtttgcattaagctggtgggaaagagacaagcaggaatcacctgacctgtggccatcttaagcgaaattttgggaacatggctgtgaaactgacacgtggggacgtaatacccagagaatgcatctcccctttggcctctgaaaggctgactggcgaccaggacccttcccccagtgaaaagcatcccctgctcccatgcgaaagcatctcctacctgtttgacaggaaaatgtcattgccagacagatgaggaagattaaggtaaggggaatcagattagtttcctctacgtagtgcccactcagacgtgctggctagctgacccacagacatctggcaacactggcaggagaccaggatcccaggggtttgactttgcccttagtagagccagacatttgttgaatcacttatctgtagaatggggttaagaaccacgaccatccgttaagaaggccatgcagattaactaatcagtggctctggagaattttgaaggatgtaaaggatctaggtacgtgctcaaattaaattgcttggagccaaacccttttacaacaccctcaatgttgctatgcaattgctctctggtgcagctgggaacatctgatcttcagtgataggatcattctctcctgcatcttcctcagacaaatggcacctgcaaccagctggcttgtatcttaacattcaaggcaaacaggttgtcatcttagctggggtgatgttgttttcaaacactgcctcctcgaggcaagcttggggggaaaaaactgtgcaacacgcacaggcgtgcacacacccctaacacacacacatactatacatatgtgcccaaaatgtcagggaacaaaacaaaatacaggtctcatcatgcaatgaaatcctccatagcaagcatgaaactatcctgataattcaaaggatgaaatgagcaaaaccaagtgtttgaatatgactgcaagtttctcccagataattttgttgactggtattgtagcaaaaaaccaacatctttcagccttgtagtctgctcttttttggaatttcaggaaagtttcagaacctgcaattgactgagaaaagggggctcatgttttcttttcaaatagctaccaggataacacagtcagtctgtgaaccaaacatgtctatttctttcctttctaaaatgtttcaattcccaggaaatgagccatggtctcccacctggtggcagcaagtgtaagtaaggatgtgtgaattggttctttagcaatgctataactctcttgggggagggatggggcttatatgaagtagaccatgtttctttctctctcatcagctgtgcttgaagaaagacaaaattttgtttattcattgggttttgaccagctatgaaatgaaaatcacatcatacaaatgattgatgaaaatctgaggggagatacactttcatggcttttgggggagataaaaggggtctgtgtatccctcctgatgactgcacagtaataaccattatcctcaaaccatatcaggacagcttttatgcacaaaactgatatttttgtacattttcttgcaaaatagcaagcatttgtttatatgatatctggtgattcctatcaatattttattagtgatttctgagcttctcaaaaataggggtggcctttctcagtgcctagttcaatgcagccctccttgattttgcttaataaacacttgctgaagcttgaaaactatccatttccagcaatgtagaggctgctgctgtgaatgaataaaaatttgttctcattggtttcagagtgagaagtaaatacttatttaaatggcatggaatatatagcccttaaggaaatacagtcaatctttccattttcagagtggttattggaactataattaagaagcaaattactaacaatttttattaatggcttggaaagtgtccttatcccatgcagtcccagcagcagcagactaataatgatattgttagcttcaggggataataaatttttttcctaagtgaacagagtatctgcagtgactgtaaacagatttgggattatagattcagatgtttaacctgttgaaggtcagaatgaaattactttcttttctcttcagtttttcccccctccttgccaagctttgatgataccatctgatttatttggtgtattctaatagttcctaagcagtcactacagggtgttctagaaaagataatgaagtattggtcagtggtctttagtttctcagagtacaattcttatgcacttattaaaatctccgactagggcttctgcagatctgcagcccaaagggaaagtgcctccaaggaaaggcaaaaaaaaaaaaaaaaaaaaaaaagaaaaaagaaaaagaaaaaaatatccatagaaaccaggaaaccattcaggggtattctaataaggattatatagttccttctgctcctgtggcactttacagtttacagagtgcttgcctctgcattattaacccttttatttccttgaacaaggcagcaggtgggggagggcaaaaataaaacttgacagcttataggatgtaatgattgaattttctattgtagatttttttaaaaatctgacatatggccttttgtgatacataggatcctcatttgtctaagaacagtcttttagctgacatttcatcagctctgaatttttttccaaagcggtggttgctgctccacttctgatgctcccagagggggccagcatagaagaggagccagagaagaaacgagaagaggcagagaccctgaaccgattactcacaaagaccttttttgttggtgcgtgtgtgttttgtaaaggaaataaattgaaatcctgctaaggatagggtgcccgacctttccaaagcccacccactgtaattctttcagtggaaaaaaaataattttaaaggaaaaaaaaaaaagcaagcaagcagccattctaaagggagatgccccaccctcaccaaagcaaatagagctcattctcaaaataataaaaacaaatttatgaattttaaaaacgaaaagaaagggacagtgaccccagataatgaaatttatctctcctctgaaaattattttaagaaaaaaaaagaaacagcttctaaaaggaagttatcctcaccctcatcaaagcccatggaacttatatcccccaaagaaaaattttaagatgaaaaaagagaaatcatcttaagttaaacagtatttctaaccttaaaatattcatgaaatttgtaaactttatttgacttcatggctcatgcttaatctcttgagaaaattaagggggcaaaaataaagggaaggtcccccaacctcatcaaagcttcctgacattattttcccgattacataaaatgtgcagaggaggcaaatccttagagatggaaaggaaatgagggaagcaatatgggaggtggaaaaggggatgatggctaaagagtacagggtttcttttgagggtgattaaaatgttctaaaatcagagaatggtgatgggtgcacaacactgtggatacaataaaacccacaaaattgtgtatgttaagatgatgaattttatggtatgtaaattacatctcaatttttaaaaatagttcaaagaaagataccatccctctaaccacaagataagagacctattattctcccaaaaacaaaaaacaaacaaaattgaaaaaaggaactaaaagaaagggagatcctcttaaaggatcttcaacctcgccaaggataataacctttatttgccaccccttcaattaaaaaaaaagaaattaaggaaaacaaacaaaaaaaggaaatctttttaagggcagatattctcaaaaatcataaaagttaatgaaatttacgaatcctcccctctagatacacacattttaattaaaaaaagaaagaaatattaaaggataggtccctgactataccaaatctccagaatttttaattccaagaagcaggggcgcggggggtgcgggagggagggacaaaagaaataccactcctccatgactaaagagcataaaccttattcttaaaatacaattttttttaagatttaaaataaaattaagaatggaagggtatatgtgttggtgaagaggatattactaatgaaacaaaaacagaatcctcttaaagagaagaagtacttcaatgtcacaaagacccattaattttcctgtcaaaacacaaccaaaaaaaaaaaaaccgatttttttaaaagaagaaaaaatgaaagaaaatccttctaatgggagttgactcaaattcactcaaaaactttattctttttattttatttatttatttttaattaatttttaactgatgcataatagatgtacatattttcagggaacatgtgataatttaatatatttatataatttaccaaaagatttattcttaatatagaatttttgtaatttgagaacaaatagaaaagataggtaggggagaaacacaaagccaagaaagtcctcttaaacaaaagtattctcagcctcaacaaagcccctttttttctcaaaacaagcaaatacatttagaattatggggggcgggaagggaagaacatgaacagtatattttaaagagaaatatttttcttaaggaatgaagatgcccccaaactcaccaaagtccttgaatatttttctgaaaacaaaaaagaaacaaagagaaggagagagggagaaagaaggaagagaagggagaaggagagagagaaacagagagaggaagggagggaggaggggagaaggagagagggagaaagaaggaagagaagggagaaggagggagagaaacagagagaggaagagagggaggaggggagaagggagggagggggaaagccggacaggtagagaggagaggaaggtaggagcaggtagggagagactgagatagggagaggaaaaaagagggagagagacagaggaagggagggagccagagagagagacaaaggggagaggtggagagggaaaaagaaagagggggagagaagggaggagagggaaaaagaaaggggagacggaggaaaggagagggagagaggaaggaggatggggggagaaatgtgaagggaaggggaaaaggactaggtaggatagagtgaaggtggcagagaaggaggggtgggaaagaggaagaagaaaattaacaaagggattattttttaaaggatcaaagaaagaaattctctccaggaaaatgcaccaacaccttactgcagacattgcgtattattcctgatgactaccctctccatcccccacaataaggaaaaaaaaaccacacacacacaaaatctctttctcaagcttcttcaaggtggggaatgtgcgtgtggggggggtggtgggtatgtacccaatctcaccctatcccagggaccttatgtatctttcagccttcactgtttcattaaaaaaaaaaaaaaaaaaaaaaaaaaaaaaaaaagcaaggaaaggaaaagaaaatctttccaggagagatgtctcccattctaatttttcccaataaactgtttcttttaaagaaaaggaaagaaagaaaaatcctactagggagggctccccagcttcattaaaacaagttgcccttgtaggtcctctccacaaaacctattttttaatggaaatcctccagacctaaagagagatgctcccccacctccaccaaaagcaatgaatcttttcccctggagatttttaaagaaaaaaatcttccattgtaagaggagataccttcaactttactaaaatcaatggactttattcctctccacatccaagaggagaaaaaaaatatttgaggaaaagggaagaaatcctcctaatctaaggcaagttggctataatccctccaacaccattgaactttcttcctgagattttttaaaagaaaaagcaaagacagaaaaaaagcctcaaaaaaaaaaaaaaaaaaaaagcactcacttctcccacaggctccacagatctgaagtgttgtacaaagaaaaggtactatccctctcaaatggcaccagtgaactttacattcagcactaaggctaaaggatgatacattttaatcccaggctggcttcccgctgccccagtctatttctggttaccttccccatcatccaggtaggcaacactcccaagaaaggcactgtccaaaagaaaaagaattaggaggcaaaccttctggggaaaaatcatacctcttttccaaaccgaacaaatgatttgggaattcgctgcgtcattgttcccatctaacactacagagaattaagagttgatgataaactcaaaagcagtgacactcttgctattaactaccaattagtcagacacccctacctaacagggaaggacccttcgccaactcagtaatggaggtgatccatcctccattatgtttcattatgtgctggctttgatgtctgttcctgcagggcgataaaagggcttgattttcacaaatccataaaatttgcaaatcatatttataagcagagagactcaattaatgttttccaaattttaaaattcatttatttctttaaaacgtaaactgatacctgctccctatgtgctatgtgtttaacattgtgctaaccactgaggattctacagtgaacaaaaccacatggatgagactacctttaagcaaaactggtaaatgagagactcaattaccaaaacaaatatgcagatggtggttatttgttttaccagatgctttgccaaggtattcactattaatagtcagttctctcagcattcctctacttaaactaaaattcaatgtaataaaataaaggaatgcatgctaatttcagagaatgtggaaaatcaagaaagcttctaaaaagtaaataaaaatcatctagtaccccaccactcagagataatcactgttaatattttgctatatttttcatttattttctctgaatatttgcttatagtcttctgtagtaagactttggggaatgcacaattgtgtctcgggcttcaccctgccccagtcacagccccacacgcttaattattagatcgtgttcattattctaccttggatttaggaaacacttgttcattttagcttaaagttcatctagtcaaactcctgtctgatctgattgttaaacatatgcttgaatcacaaccattcaggggcatatttgctgtgtgaagcagtaagtatatagattttatgtagacacaattgttgcagttgctcccatatacaaatgcagtttgatctcacatttacttactgcacttttttggacacttagattttatttgtccagttagcttttgtgacttggccttggagaaggagatccagaacaaaaccaaccttatcttcccactgttaaattcccaaagggaaaaaatctaaatttctgagtcacttttaactatatgccaaaaaaaaaaaaaattagtgatggctttgtctctttaacaagaagttacagcattatgctaaactgggtatgccatacccagaagggaaataagaatatatgaggacattatccacaattataaggaaatagaatattcaattcatccagctttcattaaccaagtgtgatcaaaacttgagagagttaataaactgtatacaacccaaccaaggctgaatcagtaatttaaaagggaagtgtaatgcattattgagtaagatcagaatcttcagcctggtcagtagcacttcagagattttcatcttccaaagcattataggcatttattgtttaagcctcttgctttaaagagcctgtaaaggaaatattggcccctgaggacagggattcttaccccttgtttccctcaagcacgtgtaggatactgagagatatgcttaatgctccccacccacccacacatccagagctttgcagtgttcttctgaaacaagaggcagtagttctgaggactgagccttttccctgcctccaagagtagaggggaatgaaagtatggcttgtaggactaaatcctggatgttcattcatttaccttctcctgcagcaaatgtctctaccttttctcttctgggattttgcagcttgacgcaggaaatgaaaggtacctgctgagcaaaaattgttaagctccttggctgtcagtaaagagacttgaaacccagaaagttttcatgaactctgggctctgtcagttgagccctcactgtcctgaagtcagctccagcatcatggtgatgtcctctgaaccccaactctaagagtagtttctcagttccattttataataaacttggtttttaattttcccttgataagtgtcacttgcatttattatgtacatttaacatattatttcatggtttattcacatcactgtgcactatagaggaaaatatgatgtagctttattaaaacagctaagtgtaaacaataaagaggacagtaaatgaagctgcagaacaagattcttgatttcagaaaattagcaagttggtacccttctcactaacctcaattaatgcttactgtgacaatttccctcctgcagagcttgagtaaaacaacttttctcttacccagaattcggatattactgtccctttcttccctacctcacctctagtgcaaactacttaactctctttgactgttaagactaattaaaatgataattttgacattgttatgatctcctctgcttgaatttacttaacttggtgacattttttttgtttgtttttttggatgtgagagcttcactttggtttcacatggaatcaaagtacccattagtggttctcttcatggctttcttattatattccttcgcacttgtgagtcctctttctagaaattcctgaaaaagccttactttgcctttccacaattccttactggcactgaactttttgaatttctctgtctttttttctaatgatgaaaatgatgaaacacaaaggtagacctttgaaacagcttgaaaggttgtttttttgtgtgggaagtactttgtactccgtatagcagggcattattgtgacctactcacaaagtatctgcttgtctgttaagtgttcaataattaggtacttggtgttttaaatgctttataatatgatacatatttggaggattgttacatgggcatttaacagtgttttaccatatttgaagaaatattgggacttttagatgtggtgggaatgcattatcgcttttccaacctaaataatggaacaaaggttcctacaattcaaaattcatcatccaacaagttttcagagatggattaggtgcagatatgagagactgcctgatagcaaattcactttgatgtaagaagtttaggggaaaaaatgaagaagttgtttgaggaacgtaggaacaatatatccccctcaaacccagagaggagagaaaactggtattaaattaagcagtgacagtgaaaagtatcagtagaagtgaagttatacttgaattgggcaggtgaggccagggccagggaatcatagggtactgattgaaagattgtaaaaaataaagtagatgaggcaagtcctattgaaattttaaagacaacagattccctggcaagtagactcagaaaaataaataaataaacgcaaccgacaaaattttgtatatcacctgattaatgttgtgcaatcattgaagagctgttgattagtataacatggctgaagtggagggttggctgatggggcatataattaaaaactatccagctttcaatttatttgtatgctaaattccaatttaaactacaaaagctaaaacgggagaaaataaatatattatctagtatccttttcctgctgtttcaggccctcttttatccacattacatggttacaaaagtctcatctgctttctctatgacattttttcctatttcatttcagtgttttctatagtggaaataagaaaccatgatgaaaatccagtgaagccttttatcttcagtattatagacccatagaatgtcctggaaagagcctttgggggtcaggtagtccagtggttttaaaacctttttagcagtagaatctcatgtttttctcaatgaaataataaatgaaagccagacacttaacataaaacatgcagtattttatcactcctcttctatgctaaaatgggtttgtaaataacttagcttcccaattgcttattttaggctaagaggagagtgtgtttgcgctccctgtttattactagctccttagcaaggaggctggtgatgcaggagcacatgggaccaaaaagaaaaagaaaaagaaagaaagaaacaagtcagggtttaaattttggcctgtaatattccagaaggtagatcatactttctcggaaacatggccgttctctcaagtttctttcttccctcctcctaacctggaatgtgttaaaactatctcataaagtgggttgtcataatgcacactgtctttgcttatagctctttattatttttggggattgtgttcctgacaaagaacactacaccaaataaactgtagatataactaaaaatatgtggtaaaagctagtatataactgtaagcctctgtaatcatttaaagcagcaaaattgttccaagtcctataaaataggcataaacgtaccatccacattgaatttgtaaggggcctcagtgtactataaactgtacatgaagcacataaaagagctaattctacataactttaatccgttgtttattatttatttagaatttacactctgcctgcatccagaaaagatacgaagtatcttacaaaatcaaatgcacataaaacagtacaattaagcacagataaaaacaggacaaagccagttcaaagcaagggtgaatcagacctagaacaaatgtatgctagttataataaaccctaattacattattaattagcggtacttttgtttgctgcctttgatggtcgaaggactttgggtaatgatttgaatgactcaggcctcttaaagttggtgtccaaggaagtttgagctgatgcaatacatcttcctgtagcaagctgcagcaactataaaatgaagaactaaaggttgccaggattgtggtataggtgttaatgagctgtcctaaaatgctgcaagactgggttattttggtgtgcctgcattttaatatgctaatgttcgtgtctgtgaggcatatcagtatggaattttctcacaaaaatctttgctccgtggtaacttgtagcaagaagttgaagagtttggactcttcttagattggaagtcacctcactttggtggactccaatttagatggtggtgcaatatggggtaaattgcttaatctttctgtggcttagcttttatgtctcttaaataaagccagtgatgtgccattaactcagctcagcagtctcatccagcaggccttcactgctatcccctccgggctagacacccagaacctagggttcccatagcaccctgtgcaaacctttgcattaccagtaggcggtggtaagcaggactgcctcatatcttcccagaggattatagatttttctaactcacacagacacaccatatgtactaggaggaggcccatattgattgtgtggtcttgaattactagtcttcagtcatgaacatagttaattttaataaaaatgagaatgatgatttatctccccagttcttaaaaaaatccaaaatgcacatttattaaaatactacataataacactaaatacagcataataacactaaagactattgcatttaagtgtactatatggagagcaggttgaaacaaataactaagtaccatttggtaaccttttcactaatcttaactgttaatcagaatttaatctatttctggtaggcttttcactttaattgaaaagctcttgactcattaccttagtgtcaaatttctcctgtacctggcacttgaatttggagctaggtgtcagtaggactattccaaggctctctcttttttgtgaggactgagaagcaacagctaagctctgatgttcctttggcagtccaagttttatctaaaatagcgttctactaattacaggaaaagccttaacttgtttcaccaatgcctctgatcagattagcaccctgaccttgaaatggtctggtcagggaagagaatatgaagtctccaatcagagagcaggaaaccccaacaggcaccttgtttccaatcagaaggaacaacttttccttttaaatgagaaggaaaacttctaccctttctagaatagctgcagggcaagatgaccacataaagttgtacaggttgtgcactatatgagggtgtcatgtctaatgggacacctttcacattgtagacaccatagatgtatatattcattgtggcaattttctagcagatggcagttaagtgccttgctttgacaaaattggtatattatgacaataagggagtgtagacaaatgtgggcaaataatgtttagggaaaaggggaggggaaaaatactgaattagaggttgaagtattggaagcaaaccaggagagaaagaatgtgtaattttttaaggaacattttcctttaaagggttgatcctgagtaattttttcaataacttctatttttcctttggctattctctctttgttgatgaaaatcctccaaatggctttgaaaggaggggaatattattaatgtgttgccattggatggaatgcaagtgtcttttctctcattacacaactgcttatttataagccttggaatatattgcgcttagggaaactagtaatgaaggttaatatttatccagttattaataggaggagtatgaaaatacttctcttttattaaaataatgagaatatattgttctgtatgtaaaaattctattttaatgttcttcacacatagtgtgaagtattaagtacctatacttaataactgctgaattaacatgaacaacaaagcagtgatagacagataaatagagacatagatagatacagatattaaaagatctccaaagacagcaagctaaaatatactcagagcattataaaatttgctctgaaaatgttgagggaaagtgaggactttcttaaagaaaactggtcttaccaagtcaacatcatcttttaggtatcaactgaataataagctccttaaaacagctgcagacagtggaggaaacaaagggaaggccagacagaataatcagggaataaatcagtaattgtttgaaagtgtgaactgaagacctagtaggtccccagtttgtggaaagaacaaaatggatgcaaattctgcaatctcatttgaaagacaaaacgtgtacattggagacaggtacataacaatataaggaaagatatgattttgttacaggaaaagtggtacagagaataatgctgtagaattataaaagaggacaaataaaggatggaggaggcttttcttgtaattagtagaaaactattttagataaaacttgaactgccaaaggaacatcagagcttagctgttgcttctcagtcctcacaaaaaaagagaggcttgcattagtcctactgacaatctagctccaaattcaagttagggaaggcttcctgatggacttgagatcaactgaatttagatctgtggagaggagaaagcattccactactagggagcaagcaacatacacaaatacctggaagcagcaagaaccctattcagctgatatcaaagagctttgagagaaaggcagagggatttggaccttattatgtatagcaggatattaattaatgttcttgagtaggagagtaacataatgaaagtactgtttttaagatatatattgtgacagtgtaaaggatagattggaagggaacaatacagaatgcagaaaggttacttgggctgttgcagaaatcaaggtgagagatgatggtggcctgcttacctcaggcaatgataatctaaaatcattcatttaacacctactctgtgttgagcgctgtgccaataactgtaatttgcctgaaggaaggaaattatagtcaagtaaaggaaataagaccaagtatacaaataactgtaatctcaaatagaaaatgaatatagccacaagagaaactcaaatttaaaggagataagaattgattggggcctagcaagatggggtagacttgggttcagtgatgagtaaaagaacattccagaatttttcttatttgggtggaggtgctgagaggagtgatgagaagggaattctaggcaagcaaaacggtgtgagcaaaggaacagagatgggaaaactgtttttttctttttctttctttttttttttaagcctgaaggtgtgagagaactgggggagaacaagtgaatagtggagtaaggagaaagaaatggtcagaggaggtagcataggatgttgataatgtctcattttctctccactctgcaactcacccttttctcaggctggctggattctttgtgggtgccatccgagggtctgcaatgctttcgtttcccctctggattgcccatttctatgcaccatctttctctgccatgagagcatcagatcttgattggctttcagagatgtccatgtctgagaagggagctaattcccccatgcattttatacagggccagttgctacatgaaggaacatctatattcagtctttggtattcaagagaatctttcagtctcagttttgtttcctgtatatgtctgtttgtcatacttttggaaggccttgtcatgcatgtaaggaatactacttctaattggctttctctctaggcttataatattgcagaatgagccttcagagaccttcccaatcaggcatgttatagccaaaaaatgtagttgtctttctaaactaccccttgatttttgtatcatactctaatgccttatacacatgcatttcccatgtcctatgtccttgtattctcaccccaatcctctgtaattagcgatattcatttaattcccattgtgcagatgagaaaaccaaagctaaaggaaacttaactgaagatcagagtcaagactgaggcccaaggctccagactacaaaaccacttcctagtccacctcaagataattaatacaaggttttcaaagcagcctctttgagcctagaaatgatctaggttcctctaaacaaagtgggataatgggggccacttgcctgccttttaggactaattactttctttagggctaaacaaatccagacttaagatgagataccattttaaggtggttgtaatgattgattttttaaaaggcttaaaacttttaaaatgcttataatgatgattcatcatttaaactgtttgagacttcctgagatcagaattctcaaaaggttctacaattcctaagagattaaaaacacaccagtctagtgctttgggcccagaattgagatttaacaggctgactctattcctagctgtgcctttgtgatttgagataaatcttttaacctctcacttcttatttatccatttgcaaacaagcatatttcccaccatagaatatctgggaagcactttaaaattctaggctcaaaggtattttaaagccttatgaattctgtaaagcactttgcatagctttaaaatgaatgtgacaccaatacatggtggaattcattcactaaaaaacagtaaagagcatggggacagggttagagcccagatttctgcctgcttactactgttttttaacaagtgcatctcaggactgtgctgtgcttccatctctgccacaatgtggtgttgtcacagcaagttggattattttgtacactgcctcttgttgagcattatgtcactaagactgattgctgggtagagatttttctaaggtagaagcctagtgaagaaggcgatttctttacttcacttccccgctttggagcctagattatatgaaagaagaaatgttttagactctttggaataatacttctctgtcctatgccttaatgtccttgtctataaaatggagttaagatttgcttctacctacagaaagtacggtgtgagggtaaatgagagagttgcagtgcaatatagcgggcttcagagtcagacgcatttgggttgcaatcccagctctgtcatttcctagctctgtgaccttgggcaaagaccctcactcacctttctgcgtctcattttccttatttatgatatcagtctaataattcccaccttgtaaggtttttctaaggatcaaatgacatatcaagttcttagttcagtgccttgtgcctaactgattctttaaaactatggtagcccctacaatgtggagaacactgattttgtttcaagcaaatgctatacttgctcatgacctctggtccgttttcctttcaaaaggatgagtgccctatgcagaataaggaaaaagtcagaacaacaaggatggctatcttaacaatgcatcttaacatcagagtcatatatcccctttaattactgctgtttccttctcttctggttaaaggggaatgttaagagaaagatccacaattcaattcaacaagtatttctgagtacttagcatgtacctctctgacttttttcatagtaagttcttgcctgttgccataatttttcatagaaaagtggtagatacttcattgatattagtaattgtaggatttcctgagttttcagtcaatgattattttaatctttcccgacatctgagctaacaatatctgactaatcactatctcatatatatattctacatataaattgtatataaatatataatttccagtgtgcatagaattggcatcaatttcatttacacttgtctctagcaagaatattagtaacacttgggtgacctgccttcaatcattgaggatgacgatgaactttcatcattctggaaaatgatgaacttccttcagcaaagaatggtgacctttcatgatcaatgtatgagagttcacaaagttttgtattaactttattccaactgctgaagaaattgctggagaaacttaagtcctgaaagaagctcttttcacttggagtctctcctaggtagatttttcaagtagatagaggcattaattcaatatctacatagagtttttttcccattcatagaggactagagaagtgccattaaatttcaaagccccatttttttattttttcacttagagaagaaaactattttgtgttgccttcctccctgccacccctcttgattagagttgttctgaatctgagaacactgacaactatattttcctaggatggccttgtaacttgagattgcagcataacaaacatggcagacacaatttctgatgcatggatttatatccataagacgaattggagggaacaaggctattctgtttatgcattgacattgcaacatctgctactattaagagacctgagctctgatatcaagtttggctaccctgacaaggtctccaagatcctaaggctcctcacagttgatgatatcttctatagtcaactctccatctctaggtgaaatgaagacagatttaggtatttaatccatggtctcaagtagccttgagatttcatagaggaggctcatggcagagcatgcctcttgtcctctgggaagaactttgactcagtagtctaaaaataacatgaatgccagggatagtcatgtatacactgctgtggtcaaatggctgtgtttgctaagcatacaccttagaagacagacaaatgattataaatggttgtgaagagacagcactgaccttctgggaagtgtgaggcaaacctagcttatgtgtcatcctgcaacaggatcaagttctgtatacagtggaaagctgccacttgaagcccaccaacggaacaaggtcagccagataaaaaaggcagggcagcaacatccaagttcccatcacagttccactcatctgagttggtgctctgtgttttataaatggcagttggaaactaaacagccagtgtatgatgtggtcaagtaatcagaagcctagaggatgaagaaaagctttctggaacacactgaaatacagcatggcttggccttggacttccagcaaatgagaatgtatgtgcagaccgttctagtcaggaactctcagaaacagaatgtctttttgcatatggagccaaatatgaatcttagttgcaaaagtatgaaaaatatctagtgtgagtagtggataaggctggcctcaaggatagggtttgtgtgtagagcatggaagatagtgaccacaattatttgcagccatgtgtatacatgactagtcatcactctcacctgtactacatttcagcataaaggacaacaatgtgtgccttgtttctcaagtccatctcgcagaaggctaatctacacattttctatgatttagaagaaagaaaatatttaaaaaacgccacatacagttagtcatcctttctaggctaaagtcaattcgagggattgactctcagttgccagggggactttcgtgggaaaagttaaagtactgtagctggagaagtcagtcaagaaagcttcaactcagtcgtaggtgctattggggccctctataccccatgcgtgtctgagcaaggtcgtggtactagtggtgtaaacagtagcacaggagtggttgtgagccggctcagctcttgaagccactgtgcttcatcattgccttttctctctagggaggctgatcactagagtctttgtatgacccattacattatttcctcagaggcagcttagggtttctgttctctggcatgtggcttctatctctgcgcagagggaggaaaaataaacaataaattagtccgccttgtctctcctcagtgtcttctagtcccaataccattgaacgttgtcttagatgtttcaaccaaggcttctactacagcagacacttcctctgtgggatggctattgatgaggtatttgaatatttcatcacctttgggtggatctttcccaggttccacttaaggaggggaaaaacaggaggagtgagggaggagatgaggctccaaatgggtaatatctcaaatgctgttacttccgctatctcccctctgactactccctgggctgccaccctaaagggcacatggttcttgctttggggtgtcaccatgtggtttagcatacaactgtcattccagagcttgatcttcctgcaatgtagtggtgatctcaacaaagaaggaaactgatgtgtgcaagctagtgtgggcaggctgttgaggctgtaagctgacaacaatgacttctactttaccctgcccctgctctgggataaaaggccccaatactcaccacaggaaaagatgccactcaattcattctaatatcctggcaattattttatcagggtgaatacagaggcacttccccattcctccctgcttcacaggttcctgcagtccctctggggcaatgaagaccattattcctagggcatcctgcagggggagttctaggtcagaaagcagatagaagcccttaacctggttcactgttgggacaccttcaactgtgactcatagtaggcatctgatcttctgagtcaccactattaagggatactggtcatccagtgctcattgtgagctcctgatagctatgcagactttacagactctcggaagaacaagagaatctattttgaagctcaccactccctacctcacgccctccatgcattattgagtccatttgtggctgtgtgtatacttatgcacactcatatggatttgcccctgctgatgtatgtgtgtttctcttcctactagtatgagttagtgtttctgtgtaggagtctagcattatgtcttttagtcaagtcctgtgaggggcattctcggataattaatagagtaatttgtttagaaagcacttcccacccccagatgtccctaagcagactgggctgatcacaaaaaatgaatgaataaataaataaatcagaactatctggggagctcccagaagatcaaatagccctatttcagatcagccatttgggatccaggaaatggtattggggccagagcctgcaagatggaagtactgggtatgagatggaaaaaaaaaagagaaaggagctttaataaaaggttaaaagtattcccacccaaaaaatggatgtaacctctgccagatgcctaatttctctttcgatgtttagaaataccacacaaatagctcttgcatttgagttgtccaggtggctggagatccatttattttacatttaacaaagggtcaaaggatctttacagatgtttttgcttaagggtcccaaataaactgtccaccacatttatctggaggttgactggggtgggggtagtttgttcagtacttgctatttttatgtcacctttaagtcgctccttttttaaaaaaaataattgaaaagcaacatttatgtcctgaaagatttccgaaaagaatacagaagatctgagttactgctccccctccttcccaagagaatttctcactggaaatccaagcaagtcacttggactctgccctgaacacaaaggattatcctgcaaataacagaaattggttaaatattggtacaacccaagggaaagtgtcagaaatctagccctaccttaagccaagttgggttttgagagttggcggataatgataactagtcagtgtttgacaatgtaagctcatagaatctgattgtctttgtatgaaacacctaaaaccagtgctctgcagtgagttccagtttactgaattttgattcatgttggttccttattaagtaggtgtgtcatgcatttgttgtacagtggccttggatctcaacttctgtgaaatatatatataatatatatatatatatattatatatatatataatatatatatattatatatatatataatatatatatattatatatatatataatatatatatatatatacatacacacacacatactacttctcgtagacattaacgaattttagatttttgacttatgtatgaccacatacttttcaagacatttatataaatcaagacagatttatataaatataaatatatatatattatatatatacacacacaatagtcatgcttccctatttaatttttataaatggagcagtataatttgaagaggaattgtaattttatgagctatttcctccccatgcacatcaggcatggtaaataaaccctcactagataatatcttttacagtattatattcagctctaggagctatggttctatgaattccatcgtagtacatatgcattagcatttatgcatgagcaataagctcaagcttttctagttagaccagtcagcgtacatgcacatgcacacatgcatgcacgtacacatgcacatatacatatacacacatgtatgcacataaatgtaaaagcctccaaaagcatgaaagacagcagaaagaatttcatgaagaacgtttctccaaaggcaatatataacaatatgctatcaaaagcatgagccagaacagtaagaattgatcaattatacctcatcaaaatttacaacttttactctgtaaaagaacttcttaagaggataaaaagacaaattgcagattaggagaaaatattttcaagtcacatatccaacaaaggacttgtatctggactctataaataactctaaaaactcaacatttaaaaaacaaaaaatctaattaaaaaagagacaaaaggcacacagagacatttcatccaagaagatatacaatagcaaataagcaaaaaatgcaaagatgttccacatcattagccattagagaaatacaaattaagaccacaatgagatgtcaccatacacctattagaatggccaaaataaaaaagtaatgacaacaccaaatgctacagaggatgtagaggaactgtatcacttataaattgttggtggaactcctattcaacatagtactggaagtcctggccagagcaatcaggcaagagaaagaaataaaggacatccaaataggaagagaggaagtcagaccatcctgtttgcagacaacatgattctatatctagaaaaccccatagtcttggccccaaaactccttcagctgataaacaacttcagcaaactctcaagatacaaaatcaatctagaaaaaccactagcattcctatacaccaacaacagccaagccaagagccaaatcaggaacgcaattccattcaccattgccataaaaggaataaaatacctaagaatacagctaaccaaggaggtgaaaaacctttacaaggacaattacaacacacttgtcaaagaaatcagagatgacacaaacacatggaaaaacatcccatgctcatggatgggaagaatcaatatcattaaaatgaccacactgcccaaagaaatttagagattcaacactgttcctatcaaagtaccaatgacattattcatagaactagaaaaaactatgtaaaaatccatattgagccaaaaaggagcccgaatagccaaggcaatcctaagtaaaaagaacaaagctggagacatcacgttactcgacttcaaattttactaaagggctacagtaaccaaaacagcacagtacaggtacaaaaacagacacatagaccaacggaacagaatagagagcctaggaataaggttgcacacctataaccatctgattttctacaaagctgacaaaaacaagcaatagggaaaagacttcctattaaataagtgatgctgggataactggctagttatatgcagaagattgaaactggaccccttccttacaccatatacaaaaattaactcaagatggattaaagacttgaatgtaaaacccaaaactataaaatccctggaagacaaactaggcaataccattctggacatacaacttggcaaagatttcatgatgaagacgccaaacacaattgcaacaaaagcaagatttgacaaacgggatctaattaaacttaagagcttcttcacaacaaaagaaactatcaacagagtaaacagacaacctacagaatgggaaaaatatttgcaaactatgcatctgacaaaggtctaatatccggcatctacaaggagcttaaacagatttacaaaaaaaaaaaaaaaaaaaaagtgggcaaaggatatgaacagacacttttcaaaagacatacacgcaacctacaagcatatgagaaaaatgctcaacattgctaataattggagaaatgcaaatcaaaaccacaacgagataccatctcacatcagtcagaatggctattaaaaagtaaaaaaattacagatgttggtgaggttgtggagaaaagggaacacttatacatttttggtggcagtgtaaattacttcaaccattgtgggaagcagtgtggcaattcctcaaagagctaagaacagagctaccatttgacccagcaatcccattactgagtatatacccaaaggaatataaatcattctaccataaagacacatgcatgtgaatgttcattgcagcactattcacaatagcaaagacatagaatcaacctaaatgcccatcaatgacagattggataaagaaaatgtagcacatacataccatggaatactatgcagccatacaaaagaatgagatcatgttttttgcaggaacatggatggagctggagaccattatccttaacaaactaatgcaggaacagaaaaccaaatactgcatgttctcacttataagtgggagctaaatgatgagaactcatggacaaaaagaggggaacaacaaacattggggcgtacttgagggtggagggtgagaggagggagaggatcagaaaaaagtaactgttgagtactgggcttaatacctgggtgacgaaatagtctgtacaacaaacccctgtgaaatgagcttacttatataacaaacctgcacatgtacccctgaacctaaaataaaagttaaaaaaataaattgctggtggaaatgtaaaatgatacagtcactttcaaaaatagtttgccagtttttttgttaacattaaacatggatgtaccatatgacccagcaattacactcttgggcatatattccagagaaatgagaacttattttcatgcagaaatgtacacacaaatattcatagcagctttatttatgatagccaaatactggagactacccataggctataaaaaccatggcacattcttatcatggaatactactcagcaacacaactttgatgaacccaaagggaattatgctgagtgtaaaaagccaacctcgaaagggtacagactgaatgatttcatttatgtaatcattgtgaattaacaaattatagaaaaggagaatagatttgtggttgccagggattagggatgggagggggcagaaggagtagatgtggctatagaaggatagcaggagagagttttgtgcctacggtacagttcagtatcttgattgtggtgatagttacccaaggctacacatgtgataaaattgcatagagctacacacacacacacacacacacacacacacacaaaatgagtgcatgtataactgtgaaatctaaataagctctatggattgtaccaatgtcattctcttgcttttgctatcatactatagttatacaagatgctaacattgggggagctaggtgaagggtgcacagaacctccctctgcatttctttgcacatttctttcctgtgagtctataattatttttaaaaatagcaatagtgtttttttaaaccccagtaataacattttttggatgctaaatattttgctttatatgtaggacataatttctttgttttatgtattaaaaatacattttggttctatctgtgtcattttgtgctcaagtatagtacagtatatttaaaagtacagcatctgttgtaaaagatgttagttctctggcatagggatgtcacagtggaaatgggaggatttatgccactggacttgaagtttcctagggtagaattgttggtgtgttgtggcaaacaagccccaaagtgacctcaaatgatccctgcctcctggtgttcacccctttgtataataccctcccctagaatgtaggcaggatctgtgaatttctgtgacttgtttctaaccaacagaatatgacaaaagttatgagatgttactcctgtgataatgttactatatgtatctatataaactctgtgttgctagtagacgagctagtcagactctctttcactggctttgtagaaataagcagccatgaagtaagtggccatgttggagaagcccatgtagcaaggaactgtgggtggcctgtaggagctaagcatggcctgcagcaaaaaactgagacctcaatcttgtaaccataaggaattgaattctgccagcaacctaagggagattgggagcatacctttccacagccaagcttttgatgagaacatagccctggaagataactagatcacagtctggtgacaccttgaagcagaggactcagctaagctgtgcctgagcctctaacctacagaaactgagataataaatggtttactttttaagccactaagtttgtggtaatttgttactcaacaatagaaatgtaatacatacatgaatcctctgcaaggtcccacttagagttgaggccacaacccacacagatctactccccataatctgtctcatcatcctgagacggagagaggtcaaaaagagcagcttcacacattttgttttttggtgaccgtgtcctgaaatagtgttgtttcttcttcttatttgtcaagggggtaccttgacacagctgagcccagggttttacagccccattgttaaactgtaatcaagaagtttaataggtttgtttgtttagaattttgtaatcatcagttctcagttgtggcatgactaatcaaaacacatttatatttggcttttggaatgtgttttatgctttcatttaaatatagttacataaacctgagtgacttcatattccattcagaaaatagatggcattatatcttggattcaagcaaagtacccaacttaagcagggtgcctgttatgagacttgaaaatgtgcatttcacatattttttagctcttagttgctctaggttgtttgttatgtgaagaaatggccttgtgagatttaccttgaggaaattaattgagcattctgattcaagaagcctcttttggggctgtaggttgcattagaacacagaactcaacaagaggacaaggaatattatctatgaaatttctcaagatccattgttgaagtgtatcaatgagaccctgaaagcattttggcccaggaagaagacataagatgacatcatttttatttatttatatcaatgtattaaaaggtttatacttaagctaatatatagctacacacacattctgttaaaaaccatataaatggcaataatacaaaatgaatatggtctgtaacatactttgacattcttagaaatagatgctattaagaaaatatgacattttactgcattttaaacttggggaagagaaagcactctctaagtgtatctactgaggcaatgagttatgaaaatgataacttacttcctcaattacctttgtgggacgttgaaaggacaaatcaggcagaatgtataaaacattttaagcatcatggaaaacgtgtgcttgatgctttttttccatacagtaaaaggttttatacacggaattttgccttcctgaaatccttcactgacagcttttcctttaactactgcttctctctttgattctactattcgctcattccagaactatcttctctcatccaaatattcgtgtacccaccttagtttcaggccatcagttagaatgtcctcttacctccaaacatgctatttggagaacattcatatatgggaatcaattagtaaaccacgattgaccacagggattccaaggcacctctgagtccttgaatgaggagatagtgtgtgtatgcactttatacattttgaggtaagagagactgtcccctttcatatttacttaaagtttatgaggttttcagttcatgtttccctgttatttctcattatgtaacttgctactcctgggtaaaaatagttcagtgaatcatgagcctggaaaagagtttcaccatgtctctaggtgagaaagacctggagaagtcaaaaagctcatcaagttaggaacactaaagtggaagttctgctcaccaggaagccatgaggattgaaggcaaatgggttgttcccttatagctaatttctctataataagcagagaaagtttattagcataagctatgcccacctactctatactcacttccccacattaaaagttcttttggttttccaaaagatttgttggtatagcaaatcttcaagtgctcctgacagaatcgagaactaaatagaattagcatttcctgcctctgcatcaaaggtaaatggaagaggaggaacttctaggaaaggtaagaacagccatttggaggggacaagttaactatacagtcatcccatatagccatgagcaaagagacggatttttttactgtgacacccactccaattctcttagcttcccaaaggcatgcagtaaataagaagatgcatttgccatttgtcactgtataactctacatctagactttccttgagagcccaaagcacatgaatgacaaagtataatagaataagaaagggttggatttttgttttaggctaagtgcatggcagaagctgttacgtagtatataattgtagacttccaggtcctgtccagtaaagtcatagatgttactcattggtatgataaaaccctgctcgtcattgttggtttcgtggaaaaatggccttgtgatatttacttttatgtcatgtaactaatttggggtttgcaaggttagactctaaaagctattgctttcctcttaggttattggcccagaattacgttatgctatgactagaatacattgacaccaggtgaatggtgatgcctcagttatggcagattatagcagctcttgaaactacgtttcccataactgtggctgatggaatacaacagaagaggatattttcaactcagcccttttttggggccttcaaaaattggctcgatgttttaataataaacattcgagagcattagattcgaaatgtcaatgtgctaaatttaaagagatacaaacacttgggttcactaatactaactgttctcatccccttattctaacactggtttctcttccaggcttcaatagagcatttctttcaacacaccttaagtcttcatacctatcatcagaagcccttctgatgtaataggttctgtttttttctctggggacctcatgagtcctagcactatgagtgtctacagtaagcacaaattcttgcacagacataaatttgattttctatttatagtctttgtttcttttcccagtgatctttgatctgttactcatgggaaggaaagagtctgtgcttgcatggactaatccacacaaatcaaaagtaccctaacctctggtagtaaagtccttctgggcttggactatttatatgtaaattatgcttccaaatttggggcaaaacactaatatcaaattgagcccccactaccctgttgcaaccacatatacacttatacttgacaagacttgtgttctaatttaggggtcaaaaatatagccaccatattcacagaaagaaataagaaatatgtattgcgtttctaccttatactgggcactttaatgcattatcttgatccctactgagagttgaatgccattatgtgtatttttacagataaaattgcaaaggtttttaagttaaatgacttgcccaaggacacacacctaataagtgatgaagctgtgtttcaaattcggatttatctgagtccaaatctacactcctttttgctgtactatattggttttgcataaatatatgtgcttggatatattaatataagaatcctcagtgtatttcttccaatagtgactggcctttaggagccaattgatagaaaaatgaatccaggaacatttgagaatacctttttcattgtcctctccagatgtgttttccccaattcaatttcactttataaatatccatcaagtgctaattatgggtaagttgtggcactttgggcactgtgcctgacagatataacttggctatgacacatatttgtgatttacccagagagttttatgctgaggtttgccttcctggcctgctcagttttgaaataatctctattcctgggcccagggtctatccccgcagtgttaaattaagtaggaggctactttatggcaacagacctaagcgatattaatagcttgttttttctgttatgccttggcttcccttgatgaatcaagtgccaaattttcatatctttatccatagttcctagcaaggagatggcagcttggagaagtgataggatttgctcacacagcaggttactgctggtggctaaactccatgaagttcagaatccattaagtccactgtctttcccaggtgccatattggtgcccatattgtacctgtgtgcaaatgtttctgtgaagtggtattattcaggtgtctcgtggttttgcaaactattcaccctctctcacctcaaaccactccccactttccaggaaagagtggcagtgtgtgtgatataatgagtagaaatgtgtctaggctttggaatcagacaaatttgagttcaaagtcatccctctttgtaactgtgtgtggtcttggagaagtctgttgaacattctgagcttcagtgtcttatctgtaatatgaggatgataataactacctcacatattgttgtgactgttagcactaatgtatacaaagggcctagcacaatatttcagaaaaggtgtagatatcagatgccagtctaattagaacattgctttttaattatatgcatggaggggtggaaggggcaagaggagggtagctgtgtcatggtatttgtgtttcaattttgggtgtgtacattgctgttagtgagtttgcttcaaactggactctcccctgccatctcccttgctccttccctttattaagctttattgtttaggccctgtttccaattaaaagacagttcttctcccccacaggacaaatttgcccactgttttgctttttttttgtgtgtgtgtgattcaagactggctgtcccccagattgcagctgataacccttctcttcccagtagccactactgcctcttcccagaaattttaaacagggagcagcacatatggattagggcacaatctcagagtcaatgaaatggtggctcagagatctttccaggaccagtgggaatcccatgtgtcattgatgggaaaataagcatcccttgtcatctacaagtctatgagtgtttgctgccacctctagccctccaatgcaacatgctcatcctattcttatttatttcctactcctcttcctcctccctttccaggcctatcagactgagttataataccactgatctcttccttccctcccacccctctctctttctctcttattgcatttgtacttttatggtcagcccttctggatatgctatcaagagttgagcagcacaaaatccagatggtaacagtcagccttgctctaagccctggctggtaggtgttagaatttgattactgtagttagtggccatttaggattcagcaaccttaatcccttatacatagcctggctagagaggagtgtaattttaccaggtgtttgcctgcagggagaagttggaaaaggatgcagatctggatggtgtttttgcctgcagggagaagtcggaaaaggatgcagatctggatggtgtttttgcctgcagggagaagttggaaaaggatgcagatctggatggtgtttcaacagggaaataaatggaggtgaaacactgtgaaaaaggtagcagtaggttctagggtaaaacatctgaacaagctgtgggaagttgctccctgggaggggaggcaatactgagagccgcactctcagtctttctcagtaagatccttgtgtgatgcttttgtgcgtaattgtatggccacgttaatttttttattactaggagctatccaggtcagaggacaatttccctttgggtccagcgtcatattactttcgttaaccaagagaatgcctgccactggcacacttgattatgtcatacttctttaccagtgatgatggcagagagttttattgcaggataacaggaaaggtaaaactaggctttgaaatatggactactaatcaaaatgatatcaaacaacacagaacatataaagtgtggcgataacagtgaaaagagccttgtactggaagtcagaaggccagaacaagtttactacttaatgaccttgggcaagtcacttttttgagtcacggtattattacctgaaaaaaaaaaaggccaatagcattacttacctggcctacccctcagggttgtgttcagaatcaagtgagaatcttcaatatctttataaccaacaaagtgctgtgtaaattaaataattattactttaattactttagcatttaaaattaaaaacaaaaacaaaactgaaccaacaagctgtgattcataccaccaaactcctgccaaatctgccttcttctgtcgattgacttagaataggatataatttccaataagaccagtggtttaaaccttccttttttccttccactgaagggataactagttattcatgtccttgtgaaacctcaagagagattttagctctgtcatttattaacgcattagggaaactacttcatctctccaagactcagattagcatggcgtctatctttcagagttgctaaaatcaaatgagataaccaatgtaacatgattagcatagtccttcccacatagtcaggactcaccaactgttagcacttcatttcactattatttctccaggaggcttgtccctgatagcctcctgttaccaagaatacattcacattggtacagcttttcagctttgttacctggccagtaatttctgtggaaccaaggcccacaacatagtttcttctttgacagactagtgtctcatgcagtcacttctcttccctctcttttccctccaagtgtgatagactgtcaaactaccatatctcctgactccatgtgaggcaattgtgttcagccagggacaatcctctgctcagaggcagcaaggctacccacagctttaggaattgagtgagggctcccatcaatctgtcatcacccattctactcccaagccaatccaacccctgaggtgaccttacctgacactttcctcctgctctcacctaccactggtggtacagaggcattctctctctctctctctgagtctctctctctctttctgaatatctctctctctctctctctcatacacacacacacatacacacacacactccttttcccaccactcatacacaactcctaatgaattagtgaatttcatcttccctagaccaccactgctgcaagaagcaaacagaaccaactggtctagcatcaatttctgtctaccttcctcatgattcttggtaatgccacttcataaaactgagaaaaagtaaaaaccaaacccacacatcccctctttataatctaaccacttattccccagaggactttttagtgaatgtattcttaagtattattcaggccttcagatgtctgtctgcatgggtccagtttggcaataaaacaatttccccagctcaggagtaaacatgtacttcccaagtatacgtgtttaggtgatgtgggctcaccatccccacttctaagaggcatttaaagccatgaatggaaagaaatgggtacttttaaaaaccagagcacagaaatcaccaaaattgagtttctctgttttgctgtttgagtgagttgtagccaaataagttacatacaggcatgcgctgcataacaatgtctcagtcgatgatggacctcatatactatggtggtcccataagattataatattgtatatttactgtaccttttctatgtttacatacacaaataccattgtgttacaactgcctacattacagtaataggttgtgcaggtttgtagcctaagagcaatagtttatgccatatagcctaggtgtgtagtaggcaataccatctaggtatctaggtttgtgtaagcatactctcttgttagcacaatgatgaaatggcctaatgacatgtttctcagaatatatctctgtctttaagtgaggcataactgtatttgcatatttacaagcttcctttttggctttaggttgcaagcacttttaaatacctctgggggctgaagtctccagatttagaagctcccaagcatggtccagcatattgttacaaagttgtatatatgcaaaattcaggattatgacatttcaggtacctctctaaaggactgtttttttttttccctgccttcttgtgaaatcatttgcagtacatggtccccttcaagaaattcagctaaactagtgggaaatctgcagatatcactggtccatggcttttcctgctgggtgaaatagtggcccctgggggaaaaaagaagtgaactgaagtgatccccaagttagatctcacacccaagtcagatcatgataaccgtcatcatgtagttatttgatatgagagtggggtggggagagacagtaaagtaaaaaagatcagggttcaaaccccagctctgctattcactgcgacttagaactagacacttaacctctctgagccccaacttcttcacttccctcacaggactgtggctgcgggcattaaataagataatgcatgtaaagcaagggcaaatagcaggcatttgccagccagaaacaaatctcttcctttggagaaggagggttgaagagaaacttagagaagaaattgctactcctgctgcttctaatgagggccatcgccagagtcacaacaggagccacagctctcatagtagatggttaggataaacagggcatgtttcttggtggtgggagcccagggttagttagaagcagtgagggaagtgtccctgagagaataaacgtccacggaatgttagcagaaccttcttctctggtagcttatggtcaggtaaaagaatggaaaagaaggcaattggaagcaggcattgctttgtcactttttatgcgatggcagcaccagataagctaactgatgtcctgacctctgtgatcttgcttaggttgaggaccagggtccaagttaccctggtatctttttggaggaactttgtgtgaccaaaacgcttcttttctaggcaagcagcaactactgctgtagccataggtgtctcccatgaagcttccacttatactattcctttcactggatttcctgtttcttggcttttggctctccaatggtcagaaacaatcctctttcccctactcagaactttgagtcttccctggatttgtggagcaaaggcaaccttctgcaggaaggtttatcataagccacttttctcctcaaacccccaaagctcttacccagcccttccttttgatcctactcttagagtcaagccattttcctgctggtttcctcacatgccattccatgccattcccctagagccctgtaactgtgcacatattccaagaggcattcccaatacagtgaaatctcaatggctgcagttatagggcaccttcactcaccttacggaggttggtgaggagtcccaacacaactgaaatacggtggcctgaggcccagtgctctacaactaatttgctatttgacttgagtaagcacagcccctcttggagcattattttcataatctctaacagggcagggagatctaagattactcattactaaggtcacggttagctcagaaagttaaaaggccagttttgtggcatgaacacagactttgaactaacatagaccagagcttgtatctccatcctaccaacttaacagtaggccccttgtcgcagtgaaatggcttgttcaaggctgcacagctagtaggcagcaaagccagcattcaaacctataagtagttctgggcgggctcagcagagctcttcctccttcctggatgcagctagtcccaggtcaattaccaagggccaggttaccactttcagaactttgtcagcctgggctcagattgctcacctcctccccataccccaaacaattagtgatccttaccctccctaggaattccagtaatagaaaagaagaaggggggaggggcagagatatttgagaagacacaggcttaaaggctaagcttccctttacattgttcctttcactgggtttcctgtttctatgtttttggctcccccaaaacttataggtgtttaggctttatggtcccagcggactagttttaaagtcatcaactcttgatatttattttatcaatgtactcagaccagtgcaaaatgacatgtatatacagagtttttgcagtgtcatttgtaataaaataagatttgaaagcactgtctttcaatagggaattgtttaaataaatcacattacattcatttagtagaatgctatgcaattgtaaaaagaaaggaaaccacttaatatgtatcaacatctaaaagggttcattgtatattaagtgtagaaagcaagaaacaaaacattgtacatagaatgctacgatttacaggaagaaaaaagaatatatgtgtatatatgtttgctcacgtgtgtaaaatacctttttagtgatatgcaaggaactggttaaagtttttgcctattcataaaaataaatacgtatagcatcattatcaactttcttttatttcactgatagagaacagggacacagacgttcatctatagctcttccttagcacaggaagcagtgggaggagatttgcagatacagtccttgcagacctgcgtggtagaaagatctggcttttcagtgttaggatgaccacgaggtctcagtttgcccaagaccctcctgattgtagtgctgaaactcctgggaaaaccaggacagttggtcatcctattcctcatcctgctgctgcagcccttagacagccaggagggaagattccagtagtggcatgagcagagcgatggcagcagcccttggctccacaatccacaagtgacaagggactcacagagtggcaggcacatgctctgtaaggtattctcatctaacagacaaggaaattgaggctcagagaggttaagtgatttgcccaaggtcacacagctagtaagtgctggagccagtctgtctgactcctgccatgtcaacaggaccctggggaatgtaaagctttcagtggagcagtgggtctgacctttcttaaagcctaaagcacccggagttgcattttaaccaaatcaaacacagttgctttgaatcaactttggcaagcgagtgttaggaaacagctttcttcccagcactctaacccaagcaaagacaatagatgttccaggtctttggactgaaggagtcatagacagaaagctggccttctcagttgtgcccgtaataattcagttctcacctgggaatgatagcttactcatcccccaacttgatccagcctcctacacaagagcaacaagagaaattaaaacggaagagcagccaactaataacaggtagtggtgcatgtcatgatgcttgtctactttttgagtgggtgggggtggaattcaacttggcttataacaggggacccttttgctaggaaaaggtaaataattccccaaagccttatgcatcaaaaacgaaccaagcaggctgaacatggtagctcatttctgtaatgggattacagaggtgggaggattgcttgagcccaggagttcaagaccagcctgggcaacatagcgagactgtctttacaaaaagatgaaaaaattagtcaggcatggtggcgggcacctgtagtcttgactactcaggagactgaagcaaggggattacttgagacaggagtttgaggttacagtgagtcatgattgcgccactgcacttcagcctgggtgacagaacaagaccctgtctcttaaaaaaaaatgcaccaagcaacagaaaaacagatgtagcagatagtagaagctttagggacttgggagaagcataggaaaaggtcacagcagcagctgtacttgccctttcccaattaagcagcaggggggtgttaattatatacaggaaattgggctgctttacagactctgttgaaatattttatagaagatattttataaatatggattgagggaaatgtttatcctcattaatttattaatttacacatgctgagttgtacagagcaccagagagagatactacctgtgccagggtgtgggagtttctgggagcaatggatttgggtattggtttatcaaagaggattcagaatgaaactgaagcagagttttccaaagctttagccttctctgcaagggctgccatggttttggcaaagaccattttgtgtgaacactgtacacaggacctgaattacgtatgccttggagtcctacattcttgaatttgaatgaagccaattgatctctgtggtgattgaattcgggacaatagactaattagcaccatactcactctcaccacaaaacaatcagccttgagggtttaatagtagaaaccataatgttatttgggttttaatgtctaatagagctggcaggaagaattaggaaccctgcctgcagtgtgctgtggtttaagaagcgtcgagtggtaacatgacatttcaatatgtacaaggattctacagcccttcctaaattatttctatctgcagcatcacagatattgccacagaaatgtggcagcttggaccaggaggactacatgtgtgtcccttcttatgaaatagctgtgtgcttataaatgtggccaccaagcaaaatttcccatatggagtcccattcctcattgccttttgtactaacatcagagatgcgttcttctgacaaatgttttaactccaagatgttgcaaagtctcaaaactgcaaaacaaacatgggctatcttatttgagaggaaaaatttcaactatttcctcgggcaagccacttgaagatgctaatttcagggtgtctttcataggacagaattgcgttagaaaacgcctttcactacctgcttcagagggctgatgagaagcaaaagcactttattaattacaaagtgctgtcaacatgtgaattctaattactcttccagtcaatcttggactgtcactttaaaaaaactggagaactcccttctcgcccgccaacgaatgttaggtctttagaaaaacaaggaatatcatttgccactttgagggaagctcattaagagttctagtatggaatagtcagagctgttcatagaatacttttttgtgtgtgtgacggagtcttgcgctgtcttccaggctggagtgcagtggcgcgatctcggctcactgcaagctccgcctcccgggttcacgccagtctcctgcctcagcctcccaagtagctgggactacaggcgcccgccaccacgcccggctaattttttttttgtatttttagtagagacggggtttcaccgtgttagccaggatggtctcgatctcctgacctcgtgatccgcccgcctcggcctcccaaagtgctgggattacaggcgtgctcgccgggccgagaatacattttaattcttagcaatctatgatcttgtcattcagaataaagtttggcagggggatggggtggggtctgtgttcaacctgttgtgtacatactaaaaaaccaggccctcccagttttctcatcacggggagaggaagcacagagtccactagcattttgtaactgtgggtacttggacaaagtaagggaaaccaagcctcagatttactgtctggaagtcagacgtgatactgcatagttgtgaggaggcaatgagatgatattatctgccagaggccagggaccaggaagcagtatgcaaatcttcttaggggataggcaagggttctcccttcagtgcctcccttggcaggatgcatttgcttgttaccttgcttcttccaatttttgcctcaggaccttgttcagtttagtagccccaagcgggtaaagattgttttacatgcacatagtttatcgacttggggcaatcaagcaatggatttttagcttctgcctgttcaaactggcttcctggggctgcctattggttttggggttttgacaaaataaacaatggtttatttagaaacagtaattgggtgagtagggaagtttccccaaaggaggacagaattcagaaggaaaaggactacaggtactttaccttttccaagatccaggtttgggcatttgtggaagttcagagctgatgacacaaagcctctgtttagaacttaaggaactcttatcatgcaccctgcgaaaggaggcattgaagggagagcccttgcctatcccctaagaagatctgcattctaacttaattaacaaaaagtaggttttaacttcattttatcttattcaaagcaatacaacttcatttggttccttccaacaatgccctcttgggtcttttaacttggtgaagaggtttatctcactaaacaattttagaaccacagagcttacttgctccctagccttgacattctgttcttgtcatggttgactgtgtcctcctgtttccagtttccagatggtaatttggcttttgacagaaacaaagtaacttgataggcaaaagaaggacagttcccacaagctaccaaccctgttctggtgccaaaggattataaactttgtgttgacaagccatagtatctgcgagagtaattctagacttaatctaaaatgtgttaataataataataataataataatttattattggaaagtagctccacaatctcatcatccacttcagaaataaatcttcctcatctccactggtagacacacattgaaactctccccttctcataccctcagacctggggtatcaggtataaaacagattacttcatttctgccatctctttttcccttaaagaactcaaacaaccactccctcaaacagccagggtgcagacagagcttttgttgtatttttcaatgaatattccacatacttatgcccctgccatatcacatgggtatatgtttatgttcctttaacaattttaacattttagtccctttaattatttttttcattattatagctttatactaggttttaaaacctaaatagcaggtagttccctcttaattattcttctttttcagaattcccagcctgtttttgcttgcttattaaaaaaaattaatagaccatttttggcagttttagatatatagaaaaattggaaagtaaagaatgtacccatataccccctcccaccccctcccagtttcccctgttacctgcttggggctactaaactgaccaaggtcctgagacaatcattattattattattattattattattattattaacgtcttgcattagtgcagtgcatttgttacaactggtgagccaatattgattttttattattaactaaaatccatcatttacatcagggttcattcttggtgttgtacattctatgagttttgacaaatgtataatgacatgtagccaccattacagtatcatacagggtagtatcactgccctaaaaatctcctgtgctccacctattcatctcttcccaactgcccttgagcttctggcagccactgtgtttttttactgtccctatagtcttgccttttccagaatatcatgtagttgtattgatatagttaatgtagccttttcagattgacttcttttacttagcaatatacatttaaagttcctccatgtctttccgtggctttatagtgcatttatttttattactggataacattccattgtctggatgtaccacagtctgtttacccactcacctattgaaggacatcttggttgtttccaagttttggcaattatgaataaaactgctataaacattcatatgcaggtttttgtgtggacataactttttaatgcatttgggtaaatagcaaagatttcaatttttagatcatgtggtagaagtatgtttgattttgtaagaaaccgccaaactgtcttccaaactagttgtaccattttgcattcctactagcaatgaaggagagttcctgttgctccatattcttgccagcatttagtattgtcactgtattgggttttagctattctaatccacatgtagtggtatttaattgttgctttatgatgtattaataatttttaaaagttatttttctagttgttgctctgggcttatacatctttacttatcagaatctatttcagatttgtattaattatggggagatatagaaaacttattcctatatagctctattgtctgtaagggccccctgagtggtagagcttaattggggtcccctgagttgagggtggctactggtttgttgggagtaggctctgaataaccaaacaggatgacttgctgaggaaggggatgtgatctacaggcagataaaataggaacttgaacaaagataataatttctccttcttgctcatagtaatatcattaaagagcttatcaaatgcataagctaaaatctgagtcctcttgggctatcatattcacaagttataaattgaaagatttttgtttactagcccatgacttgcaatgcctgaaaaataggttctttaagggtaagtgcttctcagaacaggccaagagaatgtagtagtgtaaatatctgacagtcagagttgcaacactttaaactgtgaatggagggaagggaaaagtagccaaccaaaaactgtaaaatgagctggtacaggggacattacatacgacaaaataagaagagtaaaggaagcatttaataattttaacagagcagaacaagttgggaaaagggcagagataatggatgttgattcagttgtacagaattggagccgttaaattttggaaattaagtctttagcagaaaggagtaaataggactgcctaggtattatgaagacttagtatggagaagtatatggatagaggtgagaaggttaggataaaaaaaccaaaagccatttttgagaactgtactttaggccacctggccagaaaggggaaaggaacaatatattattaatgcttatagcagttgttttctcttggatgactcaatttcaacaatttaaatataatttcttactctctctcactgcaacctccctccttcccacaagatcttattgttctctttgttctgactcctcagcaccattcttttgcatcccaagggtgttacaataaccttgaaactcccataagctatgaagagggctcaggtaaattgtgactgcttatgaactgacttttcagttgagatacagaggctctgtctactagtactatccaattggttagagaattgaagagtgtataaatgtgtgtgtatgagtacgtgtgtgtgtgtgtgtgtatgtgtgtgtgtgtgtatttgggagaacaggaatggcaaataactgtttagatcagagtcctaaactcaaattcctgctggagtcaggcaccccatctgaagggagcagctggtactcagtttctgcagattgttgccatgtgagaatataaatgcaatgttaccagatgttctaattttttttaaaaaaaaagaaacaggaaacctgaatttttatatgaagtcttccacctttcaaatattaccaactaatttgaaactttgaaaaacactaggtaggccaaacaaaatacttctccagccacccaatggtgaatgctaatttagatgatagaattcatggtagagccttgatgtggtgattttaaactcagtctggccctttgtccattaagtatggatttgattccagcttgttggggttgagtacttctcccaaatggcagtcttgcatgttggtttgtatcctataacttaagtgagaacttcctcaatgatgaaaatggtaagtagactctatgcttggttaggatcagtctgttcagcaggtaactgaaaaatcagtggttagactatgagatgtaaagaaagtaatcagaaggtagttttcttgtggttcctttttatgtgcttgctccttcatgagatcatgagtccgctgaagacaaaccatggtaaagactggatttggctctaaacgtgttgagaagctattggaggcttgcgaacaaggaaggaacatgatctaacttaatattctaaaaggaacactctaaaagagctgacaggagagccctgtctggagctacaatctggagacttccagaaaatctgcctttacagccttttcctctaccacgcattctttcctaagaatgctgttcttatatttatgatgttcatgtccctgccctctactgcaaatagagatatcctctgtggtttttgggccacatagtctgataaacgtgaaacctatatcatcctgaatgagtaatccaagggtaaccaatgtctcatctgattgaatgagcttcactgtgttctcacctggccttcaggccatttctcagatatgtgacaagatagagccttctagatatctgctgtttccatctgagaaaacaagtgatatgaccttatgaattgatctaattgctcaacaccatgcttctatctttcagaaaatattgaaggaaggacctatgctgaagaactgtaactctttcaagagatggaagcttagatattttctggttcaaggacagaagctctactttgcacaccatcccgcggtaatgtatagcatattgtcaactagattaatgggtgggtgccaggaaacctttgtgtgggaagatggactaataagtaaagacatgtcagcaaacattagggtggaagttgaagccctctactctttttttaacttgcccttttgggtcaaatggggatacttttctctcctttctcttttctgtatccctttccttttgtatttttcccagctagcttctgcacccagaaccaactataattttggggatccagtgcaaaatgaaaatgtagtgccctttattcaaaaagcagggggaagttgtattaaagctactaacatataacgctttatgtttatactaaaatattaatataaagcaaagacttgtcatggtgtttttatttgctaatgcaattctaagtaaagaaaaatacgattttaaataattagcatgaatttcactatttatctgcacactatacaacaccagttttaaatgcaaatgtaagagcatttaattcaaataaagaatcactaaaattatacaatttgtgtttagtagctcatacaagcgtagtattttgttctcagtagtataaaaaaactgcacaaaactagctcaactgttcatattttacttctcgatacttgcacattccaccaacacttttttaactgaaagaactatgggttgccttatctttccatttccttccatgtcatcatttttagcagaaattgttggctaacacaggggtgtaacgagcaagaaagaatacaatagggcttcttggttctttgtatttcttagaaaccattgtctttttcctatgtctgaagcaagttctggttccaacagaaagtatgacctctcagggctgtcagctcccctactgcttactcagttatagatgtaacacacttatcttgtacttgatttgagtcttgctaaactcccacttatcatgggtccactagaattctatgttcacgggcatcacaaatgcaaatggagcaacaagacatggggtggaaatgtataatgcgcctatctcctctgctcatatgcatgatctgttgtcccattggactttacttacaaaacacatgctcaaagacaaaattatgaggtaattttaagatgacaacaacaaagcattaaactaagtgtgaggcccttctgaacatggggccctgtgtgactgcacagtttgtatactggtgaaaccggccttgcctgtatccatgatactgatttcctgctgctggctagatggtatctactatggccagtgaataaggaggcacaggcctcaaactggatgggactagcaacactgcaaaggttgccacccaataaaataggagtttatcacaatctgtttctctaggactctagttagaccacatctcattatcttttccagcataagcctttatgtttaaataattctgagctgaccaactcaagccttcctataattccacataaatgtctgtaaaaagtttattttgatttcattttttggtcacatgatacattaacaaaaatcatgttgctaaataaattttagccctcaagccaaagaaatgattggatcatgactgccacaaatgcctgtcagtaagtgtgtgtgtgtgtgtgtgtgtgtgtgtgtgtgtgtgtttaccttttaatgtctctttgcatcattaaccagacggttccttgtccctctctgtcttatatctttccagtttgcacactttgaaacgattgatctgtctcaagccactgtggcagaaagcagctgtagaaacctttgccacagtttttgtgtaagtaagattgggaatgactgaatgggcaggggtaggggctagctgggaagatagctttccatgaccacttcttgcttctttgaacttcaggtttccaaagtttcctttgatcccaaagtgttatcattcatgcaaacattttctagcagcccactgatagggaagaaaaaaagtgatggtcttgttccttattaccagtataaagctaagctgatttcaaggggaagggagtatgtgacttataaaaatcagtcctcccagtgaaggtgatttagaagagtatcactgggagtctttcaagagactgctaatatgttatagaaaatggcaggataattgagttacatgacatcctctcctctgatgaggtagataagagccctaattcaaagtgaaatctaccccatgttgagattactgatgaaagtgcctcaaagaaagcagaagattttctagggaagtgtctagggctttgtgtgactgaaatgtcacatggctttggtcattcaagtgaatccagaccagaaaactcactgaaaaatagaaagcttggtggcccaggaattctcctacccacctccttccagaattgtcttctcccagcctcagtggtgggatatggagactggagttcctgcttaggcatgtaggggatagtacctaacagactaaagagctgcagacccaatatcctgcttccatagttggttcatgttccatcctcccttgaaaggagagcggctgggtctaagaagaagattttgctttgttactctctcattacatcaccctgacacagggtaaaactgagggctctgttgaccagtcccaaaaagctgagtctttgggtgatgagcctatagggtaatgtttttggtttccattctacaaagaaagaaatcataaaggctaggctgccccttaacttaattaaagcacagaagcactgaacatcagccccactcaagaatgggtttggaccaaaggagtggctgttatcacaatcccaactagctcctatttccatcgaccacataatctcactgtgttacatgcaaaagaagaaacaaattccttgttggtgtggtgagctctagcttcaagacttggggagcttatagtaaaggcaagtagggcaatggaagcaatgactgatgctgtagctatccatgatccctcctgccctctgggaaaagatcaagtcctgcccatggtctacatctgctagactctcagtgtggcattcttattattcctgcctgggttcttgtgccaagcagggttaagaaagacaactgtaaaattctcttcaggttgtccctaaccataagaaagaaagaaactgggtttttagacatctcactctcccactaaacagaaacagggacaccctaatgaaccacatacaattttaccacttcaagtagacagagtagcagtaagcaagtagggttttcaggcaaactaacttgagtaatagatggtacatggtttagtatttaaaagaatgaattctgaagccaaagaatctggatttcaattctggtttagttttttacctgctgggtgaccctgagcaaatcatttaactctttttgtcttggttttctcggctatgaaatgggaaaaataacaatgcccatctcacagggttgtaatgaagattgaatgaaatcatatgcataaagtgctttagaatagttcttggcacatagtgagtggcattaaaatgttaattattgctattagcattattattatttcggatgggtaactaaggagctacgagtggttctgggaatgtctgtcttatattcaagaagtggcttatgttgtgcttggtacatctgtgtagtttcttagagagttcacagactgtgtttgaaggcaaagttatggagtgggaaccagctaataatgtggctttttgtttaggttattacaccacaacgaaaaatcactctggctgcacccaaccggaaagacatggaagaatggattaacatcataaaaaccatccaacagggagaaatttataaggtaagaaaactagtagagaagccacacaattcttaataggtaaataattaattgcattagttaagccacctttagagcagggaaataataagatggaagcagagaccacctgtttaggaattatagacagaaaacctctttagaattattcataaataggagtaattcacttggactcagacctttgtgagtatgtggtgcagatacttctatacatatccacttgatatgtagatgtcaatgtatgcccaatggatgagtcactcaagatgtatgtgagcagctaatgtagatgcccttaggttaggaaaaccggaatcagcagtcttgacttgggtctgctgaatgactatagtgatagctaaggaaactgagactcagaaagaggtaggaacgagtccaaggcagaatcactattcagtagtgaaaccaggattctgatgcaggctatgtgactccaaagcctatgtccttgaccactgtgctctttgcctttctgttttctgtctactacaaaagtaatgtagagggaagagcaataagtatcctctccaaagcttagcagggttcttttttacctggtggtaccaaatctctggccactgctccctgcagtaactggtgcaatcaaacttcaggagatacactctgcctgcccttctatagatctaccacagttagaatttatgtaagttccaagaggagagagatctgtgtcacttatttacttacagcggtctctggcacatagtaaaggcacaataaatatcttttgaatgaataaatgaatctgcaggaaatcttggaaccagaatttggacagagaatgatacatggttcatcttgaagcaaagttctgctgtaaaggtcttagagataaaggggaaggtgaatccagactttaaaacaacctaatgtcttaaataactagcaatgggtagaagattgttctaggcaatttggatggagcagtgtgtgaagtggcttggtgataatgcagtttagaaataaaactaatgccatagagaagaaccatccatccctactccccgaggacttctcaggcttttgaccacttagtctcataactatacattctcctccctatagcaatgatggggaacatgacaagatggctgacttgaggtctctccaatatcattaaggcctctctcagtcccatgttatatatgcttaaattgagagatccttggcttagcatttgatggtgatctttatatgatttagcactcagaattttacctctttgttactttcttcttcctttcctaatggagaagcacatcccctttttgcccccgccccaatcaatgaggccactatggtacaacattagaggcagtcataaaaagttgtgaattccatgctcctttcctgtctttgtccctgtggaccaatatctttccttcctatgacttaacctctattcaaactggagggtttctcatgaatcatataacattttcaatttggcataaaaggtcgcataggatgttttgaattttaattattgttctaggaatgcaaaaactcctagagaaattctggtgactaccagagaattggtgcgccatccctgaattcattgaattaaacacctaggtattgattacccagcacaaactagaaaggaaaaaaatctccctgtttactctcttggaagagttgtatcaggttgtaatcacaacttctgtggagcttctccagggacctaaatctattaaggaacacttttagctgatagtgaaacgtctcggcaccagcatcttagcaatttgtcttacttgaagcttaaatagtaaaatatgctttctcccatatgtgccttatctctaatggtcccttctatcttctgtcaccaccaatgcctgacaaatagggcaagggaagattaatcatggatttagtggtctattaaagtggtgacaaagtaattggataatctattggaaactagtcagtacacattaataagccatcccctactagttgcccaattctgtttcataaagagtagaaaaaaaagatgcaatacttgctccaggcctcaatgagctttgtaggtaatagggagacgctatatacacagaaacaaaagaaacagttaaatgacagtacccaagataaatgacagttttcagagatgttacaaggcaatgcatgattgattgccagatgaatgaaacagacaataaagtggtatgggagttcagaggagaaagagataagtatgggctggagtcctctgggaagagttaacagaggagagatttgagactgaccttgaaagatagattgtattttattggtggcagggaattaggggcagtgggaggtcctgggctatggaactggtataagcaaaagctgaataacaggaaaacagaaactttttggaatacagtgaaagggagaattcatttcaccagaaaagtttaggaaagtgagtccaagaagtatgtcttgagaggtagatggggcctgaccatggagatttttcaatgccaggataaagagtggggaagatttgcaatgtgttcaaagtaaagcctcaggatggattcaaaagggaagagaattgataagagggatactttagaaatacaggatgggttagacaagggaaaaactagaggccagaagttcagagaagaggctatgattaattatggcaagaccgtgttaagccccagaatgaggatagaaagggaggacaagtgtggatactgagttaggggtgggggagaacctaaatataagaaagaggcaaatgaaatagaaaagtcacagacagatgaaaggtgtgagcctgggggatttaaagaaagaataaaaggagaaagttagaaataaggagctccttggaagactagattaaaaagttagctcttcctaatgaattgccatggaatcattgaccgtggaaacagaaatagaccttaaaagttatctggactccagatactagattttagagcatctggagatgtaagtcatgtggcctttatttgaactcttccaaaggtagagaactaagtttcttgcaaaaaagtccatctaatgttcctaaagctctaaatcttggaaatttttttctgaaactttggtctagttgaaataactttccaacattcactgtaacctgcaggaatgacatcagctggctcttgaggtggacaactccctatcattggaagtaatacaaacaaacaaattgaacaactgcttgtcagatgttgtacagaaaattgatttttttcaagtgggcaaactagatgaacttcaaaattcctttcaacttgaaaagcttatgattccaagatttcacttagcagatgagaaaactgagcctcagagaggttcagttgccttacctaaaatcataagttgattctggcaaaattaatatcttagttcttttcatttttaatctaagttctcaggaggatatcgtaaattcctcctaattatcttctttctgtcctttaatttccaccctttgtgattatggggcaggaatactaaggtagacaactgaatcgtatagatcaacaaataaattcaaagtggcaaaatgactctaactcatgcatagtgtgtccatggctagtggtttgctcaggctgagcccagtttacacttgtcccggcataagtattaacagctcccctttcactgtagaaagtggcccaatttggacaacatggtcatcctaccaatggccaacctgggaggccctaacactcttctgtaattccccaaaccttgatagaactgagcagtttagttcacattaaagcacaaaccactgacttcgttttatctaaactcaacattttatcatgtaagccatccccaaaaaggctcctttatggaattatatctgtagccaactttgtgctttgtgggatatttcacctgatacttttatgtactttgcaaacacttaatattactaaatcctcacatttggaaagtgctttggagtcaataagctttcatttaactactagacaaataattaatacacatatatgacttctcgattatgctgaaaggaattcaggaggtggagaaagtacccttagctgccctacatcagtgatgtcttagttcaggctgccataataaaaataccatagactaggtggcttaagcaacaaacatgtttttctgacacttctggaggctgtagagtccaagatcaaggtactggcaggttcagtgtctggtgaggggctgcttcttggttcatagatgggagtcttctgattgtatcctcatatggcagaaaaaggagcaagaaaactctctggggtcccttttataagagtgctaatctcattcatgagggatccatcacttcctataacgtgtggggagcatgcattcagtgcattgccatctgcccctgcacacctccaaattaatggccttctcacatgtaaaatacattcatttcacctaaaaattccaaaagtcttaactcattccaacatgaattataaagtctaaagtatcatctaaatatcatttacatcagatatgggtgagacagccttggacaaaatttatttccagctgtgaacctatgaagtcaaacaagttatgtccttccaaaatagaaatggtgaactaggcatgggatagacattctcattctaaaagggagaaatagaaaacaaggaagaaatgacaggtcccaggcaagtcgaaaacctggcaaggcaagctccatgagatcttaagtttggagaatacagatggtctccaacttacgatggtggactcacagctttttgactttacaatggtgcaaaagcaatacacatttagtagaaacagtacttcaaaattttgaattttgatcttttcctgaggtagtcataggcagtaccgtgctgggcagcagcagcaagccacagttcccagtgagccactcaatcttgagggtaaacaacccatattctacagtgcactgtgttgccaaagttttgggagatattgtactttgtgtttttacatcccatcatgtctacaaaacgtccattttttacttaacaatatttcgaacttactgggtttatcaggatgtaaccccatagtaaactgggagcatctgtaatcctctggctcaatgctctgccttccagacctacacgagtggcaacatcacccccacagatcagcagggcagtgccaatgctgtggctctctacagtggccctattcatggcatgattctctgttagaacagaagcaagtccccagggctctgctggactcttccatccccacagctctgctgggcattggtttccaccctttgaaattgacgtggagacagccttgtcacctagaactgtgcactttgggcctgtggtgggatggcagctctattgatctctgaatcacctttgggatcattctttacttgtcttgaagaacttcacatccgaatagttctatggtccagtcctgtagggtcttctttgtttcatcccattttctcaatttcctttagtctcagctgacagtggttctgctactataatcccatctctattgctggcttttgtagagatagctaattaagtctgtgattgacatccacactaatctccttatcaaatagtgggtctttcacaccttttcaaacatattttcttattttttgtaatgtggacagactgagaattttccaaaatctctaaattctatgggatttttgcttaacaatttcatcctcaattcatttatctcctctcacattttttcattttaataacattttattaaccaaatatatgtacaatattataattttaactataatcaaaataaaactgattaatgagctatttatttatgtttcattttttaaattattaattttgattgacaaatcataattacacagatttatggagtaaaatgtgatgttttcacatatgtatacgaggtggcatgattaaatcaagctaattaacatatccatcaccccgattacctatcattttttatggtgagatatttgaaatttactctcttaattatttaaaaatactctatataattcattgttattgactatagttaccctgctgcacaatagatctcaaaattcattcctcttgtctatctgaaactttgtaccctttgatatccccattccctcctcctctccctcaaccaccattctattctctacttctttgagttcaactttatcagattccatatataaatgagatcatgcagtatttgtttttctgtgctagcttatttcacttagcataatgtcctccagattcacccatgttgtcaccagtgatagaattccccgcttctttaatgctgaatagcattccattgtgtatatataccacattttatttaatcattcatttgttgatggacacttaagctgtttccatagcttgactattgtgaataatgctgcgatgaacttgggagtgcaaatatccctttgacagaatgatttcagtttcttttcacatatacctagaaatggaactactgaatcatatggttgttctatttttaggttttttgaggaacccctataccattttccataatggctatattaatttacattcctaccaacagtgcctaagagttccctattctccacatcctctccaacacttattatctttcatcttttttgttaaaaagccattctaacaggtgtggtgtggtatctcaatgtggttttaatttgcacttccttaatgattaatgatattgagcattttttcatgtacatattggccatttgtatatcttcttttgagaaatatctgttcaggtctcttgccatttttaattgggctgttttcttgctattgagttgttacagttccttatatattttggatattatcctcttatcagatgtatggtttgcaaatattttcttccactctgtgggttgtcttttcactttgttaattatttcctttgctgtatagaagatttttagtttgatgtaatctcatttgtccagttttgcatttgttgcctgtgctttgggggtcagagccaaaacatccttgcccagaccaatgttggggagctttttcccttgtgttatcacagtagttctagagtttcagcttttacagttaagtctttaacccactttgaattgattttttaatacggtataaggcagcagtcttcaaactttttggcaccagggattagtttccatggaagacaatttttccatggactgtggttgggggttggtaggggggcttcgggatgaaactgttccacctcagatcatcaggcattagttagattctcataaggagtgtgcaacctagagccctcatgtgtgcagttcacaataggattctcactcctatgagaatctaatgccactgctcatctgacaggaggtagagctcaggcagtaatgctcacttgtccactggtcacttcctattgtgcggcctggttcctaataggccatggactggtaccaatctatggctcagaggttcaggacccctcatataagggtctaattttgttctcctgtatgtggatatccagccaacatcatttattgaaaagactgtcctttctctattttgtgtttttggaaactttgtcaaaagctgtcagtcaacttttgtcagttaactgtaaatgcatgggtttatttctgggtttcctaccctgtttcatttgtcagtgtgtctgtttttatgccagtaccatgctgttttaattataatcactttacctatgttttgaaatcagcaagtgtgatgcttccagctttgttcttttggtgaagattgttttagctattcagggtcttttgtggttccacacaaatttaaggatttttttccatttgtgtgaaaaatgacactggatgatcttagaggaaaggtgttcaaaaaatgacattggaattttgatagggattgcattgaatctgtagattgctttgggtggtatgaatattttttacaaaattaattcttccaatccatgaacacagcatatctttccatttatttgtgttttcttccattttttaattgatcttctatagttttcagtatgcaggtcttttacttccttggttaaatttacgcctaagtattttcttttttgttgctattgtaagtgggattgttttcttaatttccttttcacatagttcattattggtacaagttgagcatcgcaaatttcaaaatcccaaacccgaattgctccaaaatccaaaacttttttagcaccaagatgatgcttaaaagaaatgctcattggggcatttcagatgtcagatttttggatttgggatgctcaacaagaaagcataatgcaaatacctcaaaatcctaaaaaatctgaaatctgaaacactttttggtcccaggcattttggataagagatactcaacctgtatataaaatgctactgatttttgtatgttgattttatatcctgcaactttactgaatttgtttatcagttctaacagttttttggtagagtctttaggtttttttaaatatataaggtcatgtcatcagcaactagaggcaatttcacttgtttcttttctattaggatatcttttatttatttctcctgcctaattgctctggtttttacatatgacaattatcagaatttgaaaagaagtgatgagagtgggcatccttgtccctgattttagaggaaaagctttcaacattttactatttagaatgatactagctatcagtttgttatgtggcctttattatgctggttacattccctctatacctaatctgttgagaggtttttttcttttttaaatcatgaaagggtcttgaattttgtcaaatgctttttctgcatcactgagattatcatgtgatttgaattcttcgtttgttgatatggtgaatcacacttattgatttatgtatgttgcatcatctttttatctcagggataaatcccacttgatcatggtaaatgattctttttatgtattcttaaattcagtttgctaatattttattgaggatttttgcatctgtgtttgtcagggatattagcctgtagttttctttttttgttgtgtccttgtctggctttgttgtcaatgagcatcagaatttattggatcacctctctgacactagggttggatggggccagctgttcctccatgggtaatcgctggcctaacagttatcccttggcctggggaagagttaatcagagcacccaggttgtctgaagaagctagctagggattcaagcctggaagacccgtggaccatgtttcctgcagcatggtgctattggcaagctcctctgatgtggcacttccattggcaggaacacagagcagccaccaagatctatacattgattactgtgagccccaccccattttttgtttcttactgaccccaagtgacctagccctgctggtactaccaatgtttcccgtgggacaagacaggagtggacttcctttgaagggtcccgaaatgtgaggaagttgaatatctgccttcaactctcttttcccacttagaaaccataactccagggaaattctctgaggcactgcaccagcttgagggggaagcggcatagtcaaagagaaccattactcttaccatttgaccctgggttttctcagttctgtggtccaagggggttgtctcagcctcactccaaagttctgggatattcataatggtattcttgcctgtggatagttgccagttggatttctgtagtgcagggagtgaagctggagaactcctattccaccatcttgttgatgtcactctctatcttacattttactataagcagtcaggaggaaccaaatatcctcagctaaatatcgaatttcatcattcacaagttctactttccatcaaacactagaatacaaacacaattcaggcaagttctttgccactttataacaacaatcactttttctttattgtccagtaacatgttcttggccggtccacatttctaccaaaattctgttcatgattgctcaggtatactctaagaagatagaagctttctctacagctctccttttccctttctgagctctcaccaaaatctcctttaaaattctattcagaacaatctaggctttcttggcatgtacctcaaaactcttctaatctctacccattacccagtttcaaagttttttctacatttttaagtatttgttatagcagtactcctcacttctcagtaccaattcctgtcttagtcagtttgggctgctataaaaaattccacagactaggtggcttaaaacggcaaacattatttctcacacttccggaagccagagagtccaagatcaagccactggcagactcagtgtctggtgaagacccacttcctggttcatagacaattgtcttcttgtgtcttcatatggtggaaaagggactgagatgggtctctggggtctcttttataagggcactaattcgattcatgaggattccaatctcatgacctaatcacctcccaaaggccccatctcctaataccatcacctagagggttaggatttcaacatatgatatgaagggggtacacaagcattcagtccattgcaaatgaagaatccgatcggagcaatggactgcatgaatgtattcacctaagtattttacagagagtaaaaatcaaacacaaaaacccaacaaccacacactgaaagctttaaagaaaactactttctttagcatttagagatccgtggtttgtgtacatgccacagttttaaatctgtcttcagaatggatttttaatctgtgtcaacaagtaagaagacctgtaatgatatactgtactagtttcctaaggctgctgtaacaaattactgcaaattttgtggctgaaagcaacagaaatttattttctcagagtcctggaggctagaagtctgaaatcaacatgtcaacagggccatgatctctctgtaagatttaggggaggatttttttttttttttggcttcttcctagcttctggtggttgctggtaattcttcgtgttccttagtttgctgacacatcactccaatctctgccttcatcatcacatagtattctcccctgtgtctgttccctctgtatcttcacatggtgttctcctctctgtatgtacctatgttcaaatttctctttttataaagatagcagtcattggattgaggcccaccataatatagtatgatctcatcttaaatgtaatatgtcttcaaagaccctacttccatatagaatcacagtcacaggtagtggacgttaggacttgaacatatcctttagggggatacaattcaatccacaagagtccaccctctagtcccccccaaattcatgtccttccaatgtgcaaaatacattcactgtcatctcaacctcttcaaaagccatagcacattccagcgttaaatctaagtccaaaatatcattttgtaaataatctaaatcaggtatgaatgagactctgtgtatggtccatcctcagcaatattcctctccatctatggacgtgtgaaaccaagaaaacaagctatatgcttccaaaatacaatgttgagacaggcataggacagatattcccattttgaaagggataaaatggccgggcgcggtggctcatgcctgtaatcccagcactttgggaggccgaggcgggcggatcacgaggtcaggagatcgagaccatcctggctaacacggtgaaaccccgtctctactaaaaatacaaaaaaaaaaattagccgggcgtggtggcgggcgcctgtagtcccagctactagggaggctgaggcaggagaatggcgtgaacccgggaggcggagcttgcagtgagccgagatcgcgccactgcactccagcctgggccacggtgcgagactccgtctcaaaaaaagaaagaaagggataaaatggaaggaataaaatggttgtgggtttaaaaaaaaattggcaacccagcagggcaaattccatcaggttctccaggcctgagaataattctctggggctaggtgttctgttctctaaccctactctcttagctcactggagagtcaatccccccacaagcccctgcacaaccaaggagacagccccaccttctggaacccaggagacaactccaccctctggaaccaaggaggcagtgcctctgccccttgggcccacattctttgggcctatgatggcaacagcagcatctctggcctctgagcctctctcggcagccttgctggcctctgagctacccctggaagtcattcttccattttcttgaaggataacacatgttcacagctgagtcgctttatcagtgtgtttcatgcctatagaatctcagaagtctgacaaccttccttcattttatcccatatctgtacccttaagtccaagttcagtccaatctgacagtgttctgctgaagtggttaatcggagccaggtgtcccacatctaatctctccagcaaaagtttgtccagacacacccttgatgttctctgcagggcacactttcttgggttttgcaatatggataggctgagaattttctaaatcttctagttctggtgactttttgcttaatagttctgttatggactgcattgtgtgccctccacccaaattaatatgtggatgccctaacccctaatgtgactttggagataggacatttaggaggcaaataaggttaaatgtggccatagggtggggacctaatctgataggattagtggccttataataagaggaaaagaaagaggtgttctctctctctctctctttctttcttctctctctctctctctgcatgcacacgttgaggaaaaaccacaagagtacacagtgagaaggtggccttctacaagctaggaaggaagccctcaccaaggactgaattgattgataccttgatcttggactttccagctgtaaactgtgagaaaattagatttctgtttttaaaccactcagtctatgctattttttatgatgcctgagcagactaacacaatttctttcctcagtgtatcacttccctatcacatattactataaacagcaaagagaaaccaagatgcacctcttatactttgcttggaaatctcctcagtcaaatattcaagtttattgctcacaaagtctactttccacccaacagtagagcaaaatcagccatgttctctgctaccttataaaagtattacctttcctttagtttccaatatgttccacatattcacatgaggcctcatcagaaacacctttaatgttcatatttttagaaacactcagttcaaggcaatctaggctttttctagcatgtgtctcaaaattcttctagtctacccattacccagttccaaagccacttccacatttttaggtatttgttacagcagcaccccatttcccagtaccaaaatctgtattagtttcctagggctgccataataaaataactacaaactggatggcttaaaaccaacagcaacttgctgtctcacagttttagagtctagaagtcccaaattaaggtatctgcagagccatgctttctctgatgaccctagggaaggatctttctttgcctcctcctagcttctggtgattgcaggcaaactttggcattttttggcttgcagatgcatcattccaatctccaccttcattgtcacctggtgttctcccctgtgtctgtgtgctctgtatctttacaaggtgttctcctctttgtgtgtgcctgtctgtgtccaaattcctctcttcttataaggataccagtcattggattagggcccgttctaatccattatggcctcatcttaatttgattatatcggttaaacccctatttccaagtaaggtcacattcataggtaccaagggttaggacttgaacatatttctgaggggacacagttcaatcgccacacatactcatccagggtgggaagcatcaactttttcttacagaataggatgtacacaaggaatataaattccatcacctcaactgctgaacctaagtaatgtccattttacctattcctttgtattctgtaggcaatttagatgatgaaatttaatattatacccaggcagagctctgaatttcttccacgcagtcctgtgaaaccttgcacattctagaagagcttcacttgtcactctatacaggaatgatctgttttagaatttgtttcctccagtagactataaattccttgagggaaacaactatggtttattcatctctgcatctccagtgcctaccatggtagatgatacataataggttcttagtaattattggaggagaggagactgggagggaaaaaaaagatgcttgtagaattacaatctagtgacttggggagtagaaaggttctaggagctcaaagtgccaaagccaagagtatgtcactccctcaggactctccatcttctattctaatcaccctagagctttccagtgtcttaatgtacaataaacattacaatcacaaagcaatcccagaacatgtgagcctttagttcatcaaaatagctttcccttccagaaggttccaggttaaatcaacagtagcttagcacgtaaccagcatgccagaagtgggaaggagtggtcagagagggcaatgtgcaggctatgtcttggatatctaattcatgtaaattgatcaaggatgaatacttaatgtgctagagccctcagtagctagctctctctctctctctctctctctctctctccccccactgtcaactgatgtcagaaagaaaatatagttctttttaaagtcttgtcatgcctttacacacccaactcattataatgtcaagaatgaaaagctctgtgtacgcctatgtctgaacttcaggggaaggcagagaaggagaaaatcagacattctcaggaattagtgaaaaggtgtaagagtccttggagtttttttggtgctcacccttcccttctttcaatctcaaaactgttgctggtatacccttgctttccctacagtcatgaaagtcaggctgtgaaatacaaatgcagcatttaacaaaaaatgttaaggcacattaacaaaaaatgtcaaactcagtaccatgaaagaggacaccaaaaagaatgccactccatgtaggcaggggttgtgtcttgttcactatatctcaaatgctttgaaaagtgccaagcacaaagtatttactcagtaaatatttgtttaatggattattggatgaattaagctgattaatcaggaaactgctgtaggcagtcagagcgtggtattcctaaaagaatactcaagggattcctaaaagaatcccctgagatgaaactgtcgtccaggtaaagcaatgctctgctcacctggcagccaggaaggaaagtgtatacctccaggaggtagttaaagccttattataatattccctagcccagagtcagagccttacctcctgtctttattccctggctagagaaccaaggccaaggctaagacaacacatttttgcttgaactaagacaatagagtgattggccaagcagtataaagatcattactcctggccgggcacagtggctcacgcttgtaatcccagcacttcaggaggccgaggcaggcagatcacttgaccccgtctctactaaaaatacaaaaattagccgggcgtggtggtgcatgcctgtagtcccagctacttgggaggctgaggcaggagaatcacttgaatccgggaggcggaggttgcagtgagccgagattgcgacactgcactccagcctggtgacagatcaagacttcctctcaaaaaaaaaaaaaaaaaaagataattactcctgccttcagcttctattccagggtctgcccctctattatttttctttttgaaacgactggcaaaacaaacaaaaacgcacacaaagtatcccaggtcccaggtattggctccaactttcagtcttccccttcacacgctctgacacctatacagcaggccattttagacttagcagcagattttcaggccctctttaatccgtctctgtgattcatcctccattctctcttctcgtttatttattttagatacctgcagcagaaaacaacccttttcttgttggaatgcattgttggtactccagttacagccaccggacccagcactgcaatgtttgtcgagagagcattcctgccttatctagagatgccatcatctgtgaaggtacctttctgattcctttaggaagtgaagctcagtgggtagatatagggatgaaggaactcatgtggctttagtatcattaactcatactaggtcactgactctggtgtgaggttaaccctgattgaggaaagaaaaagggaggaaactaacataaaggggatgaaaatagaaggatgagtgtggggggatgggactatattatcacaagtgttaaaaagacagaaatcacctcattcttaccatcaattttcattcaagttggataataaaaagattagccagtaagaataaaaaggaactggatcctattggaaataggtttttggaggtgcattagaactatttagaatgcatctgtgttctaactttcagagcagctttgggaagagaattagaatcctcactgtcaccagattcacacccatcttttctcttcctcttctcacagtgtgcaaagtgaaatctcacagattgtgtgctttgagagcaagcaaagactgcaagtggaatacattgtctatcactgatgacctccttctgcctgcagatgaagtagtaagtactagccatgtcttcccacagtcggcctctcccatgtccccttcaaccaggatacacagggggaggaagacttcttcctaactccagataagcaaagtcctaggctcacaatccaacttatctggaagaatgaacctccctcctccacttgtcattgttcacttgcattggagtagggagggcagggtcatttgggtcatttacctaatgtcctccatggagtagtacaattattccagttggcccttcctctccttatgtctctaacttctacctcctgtgtctttttacccttctgcagaacatgccccatcaatgggtagaaggaaacatgcctgtcagctctcagtgtgcagtgtgtcatgagagctgtggcagttatcaaagacttcaagacttccgctgcctgtggtgtaattctacggtaagactcttctcatcttgatatttagagaacttaactcctggcgagggagtggcttagagcttgaccatgtatacacatagatagaaatctaagaaactcttatctcaaaacaggttaaacagattccatagtataaatcttagtatcctgcctttccagatctgactatggagcctttctttgggagaaagatttaagaccatctttgttgcttcttaattggtgaggcctactaacaaatgggaaaagctgagctctctaatggcagtatgggcaattaaaaataagttctgagtctgcctttgagaaacctactccctttctcattcactatttcctaggaacttgtaacctttattaattaaaaatggttgataatattaacacattattattgccactatatactgagtgcttaatatacatgatctcatttattccttccaataagcctaaaccgggcctcattgttcccattttacagatgaggaaggtgagggtcagaaaagtgaaggggtccaaggtcatttggaccaatttcatttgtccaaggtcattcagccagtaagcaagagtcttgattcatacataattctgcaaagactatgctcttttttgttttgttttgttttttgtttttgagacagggtctcactatgccgcccaggctggagtacagtggcacaatcacagctcactgcagcctcaaactcctgggctcgtgtgaggtgggctcctctcacctcagcctcctcagagtagccgggactacaggcacatgccaccatgcccagctaattttttaatttttttgtagagacggagtcttgctatgttgcccaggctggtctcaaactcctgggctcaagtgatcctcctaccttggcctcccaaagtgctggacttatgagcataagccaccgttcccagccgaccacactcttaactacaacactaccatgcctctaaaccagtggtcctcaactgggggtaatttagccccccaggagacatttgtcagtgtgtggagacattttttatttttgcaactcagggtggagggaagcgctactgacatggagtgggtagaggcctggtattctgctgaacctcctacaatgcacaggtcagcctctcataacaaagaactatctggctcaaaatatcagtaatgctgaagttgagagaccctgatctagatttctagccttttagatgcttctccaaaactgagttttctagacaagaagaaactgaagtatgggcttcttcttagaagactctggttgtcctctgtttttttttttcaattgcttttgaataaccaggccaggttcattccccctagaaaatgtgtaattttccaggaagtggcacttgaagatgtcagaaatctggaaagaatggccgcttgtgggaaaggcagcagagtctcagctgtcacttcccagctgtttgaccttgggcaaaaccctttacctctctgagctttggcatcttcatttttaaaatgaattcaatagtgttttttctacctcacacacctgttgttataaggattgaagtgtaatattagattattattattaactcttttatactgcatgtaagttccccattctgcaggccactaaggttgtgccttagaactggtgatttctcagtgcctgtaggtgggtatcttctgaaagctacctttgaaaggaccagagttctgaggccacactgagagacagtgtaggctcagagtagaatgggggtgttcaggtgagttagggatatatgtatggcaccaaatctcagaaagggagattaaatactaagaatctaaatcttggtattggaactcaagactgatcaatgatatccttttctctccccctccttttttttctctgctcttctcttgtcgtttcaggtgcatgatgactgtaggagacggttttccaaggaatgttgcttcagaagccatcgctcatcagtcattcctcccactgctctaagcgaccccaaaggcgatggtgagtagttaaatcttaacctcagaagcacattgg

SEQ ID NO: 1018 - DNA, 69572 bp, mus musculus; identical to SEQ ID NO: 1017

SEQ ID NO: 1019 - DNA, 19187 bp, mus musculus; identical to SEQ ID NO: 153

SEQ ID NO: 1020 - DNA, 18760 bp, mus musculus; identical to SEQ ID NO: 154

SEQ ID NO: 1021 - DNA, 38798 bp, mus musculus; identical to SEQ ID NO: 155

SEQ ID NO: 1022 - DNA, 38798 bp, mus musculus; identical to SEQ ID NO: 155

SEQ ID NO: 1023 - DNA, 35276 bp, mus musculus
acggaagcccggaaggaggggcagggggcggtggctcaggtttctccgggcggcggcggcggcggcgacggcgacggcgacggcagcggggacggcagcagtagcgggagcagcagcgtggacgcggctggcgctggcgccatgaacccgctgtaaggcgcaggctgtgcagcacggggtgcgggggaggaggaggaggacgccgcggtgaagttctccgccatgaacctgaggggcctcttccaggacttcaacccgaggtgaggcggcgtcgttggcgcccccgggagtccgcgctgcgggctcgggcgcgggctggtgttcggctccggggaggcacggcgggcgagatgctgcagcccgaggacccgggcgcctgcccgagcctccctgcgggtgcaagcggtccccaggcaaaacagtcggcctcggcgcccgcccgcttcctcctcccgtgcccggtgctttcagcccctgcccggccacggccggaagggcccggccgcgagccccgtcctgccccaagggaaccccattcttttctgcttgctgtccctcattggtgtcccaacttcttcgtctcggttccatcctcttctgcgccgctgcgggccctccattctccgcgtcagggccgtctcactcgacccaacacccctacccccaccccagctgtttcctccagttcctcgcagtccttggggttttccttgggtttatgcccatccctctcttgtttgcttctttgttgaacggatacctgaaacactgttgaatccttggagtcagtgtcggggtatggcaataccttatataatgcatttctgggtgagcctgatcattttccatactcattttctcatcagtcttcactacaagtttatttgcaggaagtagatattgctgtccttcttttccagatggggaacacccagtggacagtgtggagaaaacactggctaagcactcaagcgcctgtccttgcacttgcccgactgttttgtaactgttctttaccccaggctgtgagctccctgaagctgagaccatctcctgctcatctcagtgtccccagcgcctcccacccaccgtatctggcacatagtaggcacatataaaatgtttgtggaactaaactgagcccaaagacttggattggagacgaggccatatgtaactgggtgattctctgcccttctttggcccttctgtaaaatgaggagttggcctaactgatctcttaaatgcactactctccgaaaggagtatccgtttcccttatttgccagttgggaagacgtgctcagtaaatatttgtgtgctgtaacctatgctaggtgctttagatgctggcggtctcagcatggggtgaagaagggcttgtacacttaagatgccttacagtactgtgcagtgctgtactgcgggggggccaactctggggacctatgccttggctgcttgttgaggatgaaaggaagttttaggggagtatttgtatgttgagggtgcagtctccctagggatggtgacattttaacttgtgagtcattgtgactttgtatgtgctcttattccactttgagttcatgttctggttaggagtgccagtgtctctaacacggtgcagacattatcattgttggcttcgaaggcatagaggaggtaacagaactaactgcagtcccttcctctgctgcatcagggggttaagattggtctgcagggtagtagggttggtgctgtggctggacaagccctgtatgtcttctatttggagatggtgataagaaagttaagtaaaaactgaattgttttgtgcccttgggcaactcacttatctattgttttatctgtagaatgagtataatctctcagtggggtagggaggccaattaaggattgattacaaagtgccttacaaatagaaagctacagtgacttgtttgcaaggtgacagagaattcagaagcctcaagaaactgccttaagtgatcaaacaggctaacagagttgccaaagcaaaatagtgctgcactgatactacctttaaccgttttttcctttagcccttttccccccaaaaaaattagtatatgaaattacagtgaaatacctggtatctaagcagatttatagtaattctcaacatattcatcaatctcttaattctacctgcattaaaatgtatttctacctgaaaagtttaaaggtcttttatactgtgccattttcctgattcattgttgccagaggtagtgagttccttaattttacagatatttcaagaggacattggccaggtattattggtaaatcagatttgtttttttagctggtagtgtttcacctctcctgagcactcctagtttttgacagtgtgctttagtctccttccatgctgaggaaggccttctctataggagaaagaaaactgaggggtgtacacaggaagttaccttatgctggggactcaaaccttgatgctactgctttgctccctgcctctatttttgaaccaattcaacatctccctcctaccccaggaccttgtcacacactgttctctttaccaggaatgtttccctctcttttcctctcctccagacctagtgaactcctatttatcctcacttggcacttgctaagggaagcattcctgacttccctgaccagatttactgctccctgtttctacagttcctgtagtatttactactcctccatcatagtgcatatttgtacccttgtgtctgtctggatgcttatttgattaatacctgcctcccccactaaactttaagctccatggggtcaaggccgtgactgtgtcagtatcgtagcctgcatacttggaatagtacctggctcaataaatatttgtggagtaaataactgaataactctccagagcctataagataaatctagagctgctgctttcaatcactgctttcctggtggtctgtggcctggttctctttcttctcacactcttcccaccttcagagtgcagccattgctttggagagatgggagagaacatggcactaaggcagaatatggctatatttactttgaagagcatgtctttgtcatagaaatagtcactgtcatggtttggtgggtcccaaggcatgggtcatggctccagatcccctttccagccttttggatcttggtaagtctgaacccactgctgcgttggcaaggctctggaaactatagtgacagagaatgattcacaagtgtcaacactcagatgtacagggctgccagctgacccactctacctatttccatctggcactgaactggttgatcatgaacttcttttcataattgctttttagttatgcaggttaagacatgccgaaacagatgtaccggacccacaaacaagtccttccttgaatgcctgaggcttcctaacagtgaaagagccctgttcttagagtaggcaaactgattctgaggcattgtaggtggtagggatctggtagtaggtagcattaggtgggctcccggcactcaccatggagccttgaaattttctgctactttgggggagttgctggttcagagaaggcccttccaccctggtagccatgtggcactggaaggctgtgaaaactctgctgggccttcttagtcatctgttgtgagctcctgatgggagtgtggtgtatccctcaggtgtgctagactggaacaaaggctgagaagtgttgctctgggggttccaacttgtgggcatggggtactgatgagatcagtagtgtttggagacttctgtatgctccatcttcagaagacattctggagtccatataagttatcttgtctcttgtttgaagcaggaaaaaggaatgcgattgctggtaatatagttcactaaagtcagctacctggcctctaacagttatttgcaaagtatattataacattgattcctcaaacatctagattcctatctcgtgccaagtgatgtactaggtgctctaagtacaaaaataaaggaatatagtcctcctctcaatgcgtaagcctagtggaagaagcagaaatgaaagggaaataagaattcaatagagtatgaggcattacagtgaaagaaaccaaatgtcttagaagtacaaatggcagagctactaattctgtctcgagcaggcagggaagagtctatagtggaaatgacttttgagctagattttgaattgagctagtcttttgagccagacttttgagctagaattgtagggttgtcatcagaccagagagtaggaagggtaccttgtgaggaagagagagagagatcagattgttactgtgtctatgtagaaaaggaagacataagaaactccattttgatctgtactaagaaaaattgtttctgctttgagatgctgttaacctgtaactttagtcccaaccctgtgctcacagaaacctgtgctgtaatgaatcaaggtttaatggatttagggctgtgcaggatgtaccttgttaacaatatgtttgcaggcagtatgcttggtaaaagtcatcgccattctccattctcgattaaccagggacacagtgcactgcggaaggccgcagggacatctgcccaagaaagcctgggtattgtccaaggtttccccccactgagacagcctgagatatggccttgtgggaaaggaaagaccttaccaccccccagcccgacacccgtaaagtgtctgtgctgaggaggagtagtgaaagaggggggcctctttgcagttgagataagaggaaggcttctgtctcctgctcatccctgggaatggaatgtctctgtgtaaagctgaccattcccattcgttctattctgagataggagaaaaccaccctgtggctggaggcgaagtatgctggcagcaatactgctctgttactctttgctacactgagttgtttgggtaaagagaaacataaatctagcctgcgtgcacatccaggcacagtacctttccttgaacttattcatgatacagattcctttgctcacgtttccctgctgaccttctccccacctgttgccctgctacactcccctcgctaagatagtaaaaataatgatcagtaaatactgaggtaactcagaggctagcgctggtgcgggtcctccgtatgctgagtgccggtcccctgggcccactgttctttctctatactttgtttctgtgtcttatttcttttctcagtctcgtcccacctgacgagaaatacccacaggtgtggaggggctggcccctttcagtatctcagaagggacaaagtacacaaaggcatggggtcatgatagtgcctggtatgttcaggtagtgaagaggtccatgtggtatgagcactgcagatgatatgtgtcgtatgaattaaaaatacatagttactgcaaatagtttttacaggttattgtttttaagaaagcagtatctaatgcacgagtgtactgtcagtactgtcaatgaactacttaccactcaagtgactgcttatctgttgttctgtcctctcaagccacctacagtcagaaaatggtcttgattttactgatgttgctgttaataatagctgtgacttcttgagtacccaccacatgccaggcccaatgtaggggctttgcatccattatccatgatctttacaacaaccctgcaaaattaggtatcagccttattttaaagtcttgacagcttgtgacttccctgaagttgcataggcaggaagaatctaagtcaacattcgaatccacgtcagtctcatgaagcctgtgctctttcctgcgtgccatgccatagttctagttaagtgacaactcctttcctccatgacattgtagatccagtatgctaaggaaccctctatttacaaattgtaagtgattaaacaaaacaaacctgttagtggcgcttatacatccaaatgagtgttgttattcaaagaggttacttggggaaagagaatgtatacacctattccattgttcatactccttgttactcatctggaattccctttaaagtcagtttacatatcacataagaagatccatctcattgctttatgatcatctatcattttcaaccaaaatagttccacctagtttgatcacacatcttattcactaaccttggctctgactgactgtttgccatttccaaaatttgaatccaccctcagtgaaaatttagcaccatttgggatagtcagaagatcagactgcaggttctcaaggtgcttccaagaagaaagcttcaaagatgatttgagtaatgaagtaccattggaattactgcattgcctcccaaggggactggttaaaggagagaaatctcatttgaatgtataatttccagttttaaaagtatcattcctattacttgataattacacacacattgttcttagctgtgttctttgagggccaggatttggaggtgctgaattacgtgctgaatgagtggatgttgggtacaaatagacatctaccactgggaagtctttgttgtacaggagagaccgtggattgaaggagttttagatagtttcctaggactccagaagttaagctttttaatatggagcttgagttttctaatcattttgcctgatatgtcatgcctgtacaagatgactggaatttaagacaaaagcctcgaactctggagatagatgctttataagtggagactcatactttgtcagctccaacctaatagtgacaacaatgattgctaaatgagattattacctacaatgtggcagaacttttgtctttcataatactgctaaagctagaatgggtaaaatgtatcatttacacagtgctttcacatacccttgtcttaatgaatcagtatatgaggaatcagatgaggagacagacctgggggaaaataactcacccaagaccacaccgctgatgaatggcagttgaggaacttaaatgcagatcttcctactggcctgggctctgcttttatttggcttttgtgcttttttgtatctactggttaaatgctcttaaacattttttatcttaataaaaccagctaaagtctccactaaaagactttaaatttggttaataaggtgtaagaggggcagttcccttgatagtttgtgagtatgtcaggttgtcatttggagccattctgtcaagctttagactgggatgtgccatccaaagtttgtgtgtgtgtatgtgcttgtgcgtgtgtacgtgcatgcaggcatgtgttaatgcgcgtgtatgtgctccagtgaagccagcagcttccactggaaaaaaactgataggtctaaaaagagtccagctgcattcttatgatatgcagaaaacagatactagaacttttacattcagagtcatcattcctttgctaagtatattctctctctccctcccttcttccttttctccctccctattctcccaaccctgcaaagtggagagagggaatttgagcctgagcagaaagctccatgtaaatttcagagaggatactagctttggcccaggtagcactacttagtgattcatcgtatactaacactacagattcaaatgagagtggaataaatccattctaaaggtgtaactggaaaagtgaattttaagaagtagtgattaatgttaaaccagaacctcccatttctcccaggtttgtggagaattaagcagtctatttttatacttggaatctggtctgaatgtttcttgaaaagtaactcaaagtagtttaggctatgaccataagttatttttgtaaatacattttcttatcactgtattattgcatattattgtgtattcttttgcaaatcaggcttgatatttccttttggctatgcagtcaccttttagactttgcttgcaaatatattgatatagttaagatactattctttctttccccaactaggagtgtgtatgaattacatcttttgaacttactgattgtattactttgttttacttgatcaactttgtagtttaatttttttaaaaagctagctgttgggattactgatcagtttcatttttatatctatatttctacttttagttttattattttcatgttttggctttttccccaaatttcttagaaactcagtttactagttttcttttgcctcttttttttttctttgttttctacttttacttaaacattttaaatgaacacattttctcttgagttttgttttggcagctgcccaggtatttttatgtttcaattgtattttagtaactctactaaactgcttaacaaatcagtattgaaaatgatccattttttgtcagtgtttttatgaattgtataaaatgtcaacctctggtctctactgattacaatctaccttacacactcatatgtatcttctgtcactcttgttgagaaaatctgcagtggccccatattacctattaataaattccaaggactttaccttgatattcacattcccctaccatgttaccacagccaacttctggcttattccccccagtaccctttctcctgtctctgcagcaccctacccaccacgatttatagaaagtattctgtgtgttccagtctgctggaattggagaggggaggataaagaggggatgagcaatgggtacaataatacagttagatagaaataataaatctagtgtttggtagcacaagagggcaaatatagttaataatgtatatttgcaaataactaaaagagtggaattgaaatgtgcctaacacaagtaagtgatcagtgcttgaggtgatggatatcccagttactctgatttgatcattacacattgtatgcttgcatcacagtatcacgtgtaccccataaataggcacaactgttttgtatccataataaataaaaataatttttaaaaaattggaaaacatcttattccctttgtctggaattccttattcccaacttgttgcccagattccacttctcttcccatctctctcagggaaattaatcttccaagtcccctagtttaccatatgtagttacttgttgatacatcatctccctctgttcctattagtctgagcatcttgagcgaacgcattgttgctcctttttatgtatctcacacatttcaggcactcaaatatttttaacaattgtaaattagatgtgtgtttattgtgtattgctgccccatgatcctttttttctccctggaaaaactatatatatgtaaagcaagtatgttttcttgttctgctacgtaattatcttcatataagcttgctgttttttaaattttctcgttctgctacttaattctcttcatataaccttgctgttttttaaatctactcttgtgttcatttccgtattttccttaggaactttgtctgttttatctgtcatgatttaagagtagcatgaggaagcccacaattaaaatatttctgtgtatccttaaaaaagaaaaattgtaaaattatttccatattccatggtcatgttaggtttttgttatttaggttttccttattagtccttttagcattttaatactttcggctttgaaatctaatttatctaattttaaagatagtaaattgttgctcttgtcttcatccaggcgtgctaaacctctgtcatctgatttctgatagttggttcgacttttgactttggttccaagcgtaactcttgaatgtaacaggtttactttcttaatctaggaagcaacctttctttttacagagctgtggtaggcagaataatgacgcccccaagtatgtccacatcctaatccgtggaaccagggaatatgttctgttacatggcaaaggggaattaaggtagcagatggaattaagtttgctcatcagctgaccttaaaatagattattctggattctctggctgagcccaatgtaattacagggcccttaaatatagaagagggagacagaaaaggaggtcagagtgattcagtatgagaagaactgcattctccattgttgactttgaagatggaggaaggggccatgagctaaggaatgtggcagcctctagagctagaaaaggcaaagaaacattctctcctagagccttcagtagcatagtcctgctgacacctcaagtttagcccagcgagacccatattggactctgacctccagaattgtaagggttatgccttttaaaccactaggtttatgctttttaaaccactaggtttgtggcagttttgaatggcagcaataggaaattaataagagaacattcagctcatgtatatttttctaaccctagtatttgaatcatgaattatattttgtgggtccttttgtaagtttatcttgttttctatttttcatgtaatagacataaaattttaagtttcctttaaattatgtcaaaaaccacataaaataatcccttttccaacatttaaaacattttggtacttctcttttctttagttccactactctctttttttattaaataaggaaactgttttacagaggataatgaagttagcttacagcatttaccaccccccccaccaatttactttttatttatagtctgaaaatcctttaggataaaaattacctgtacatgttatctaatttacatatgaatcctgtgtcgtcattatcttagcatttgttaatgtttgaatccactaatttcttttttaaatagtctgttttcaagtccattgtttctggtaattatatttgtagccacaggctttagttgacaaattggttctgatttttttagattttggaatatttccctctgctttaagagagaaaacttctgcctctactaattgtgtactgtaattgtggtgataactccatttctattaacttgtgaatcaccttgacacaggctctcttcttgtccaaagtctaagggatgaagtcatttttatcttggtttctttaaatgttctttctttgtagcagcttataaaagcctgtttttgttttcgagtattaataatattagctaatgtgtattgagtacgctggttatcagactgtttcccacagaccttgggagtgggccttgagaccctttccaggtatctgcaaagtcaaaattataatactaagacattctttgccttggtcgacattggcactggtggtacaaaagtagtgcatcaaacagctggtgctggagcacaaatcaggacagtggcaccagctgcactagtcttctgtcactggattcttcaccaccacgtgctggacttgcagttaaaaaaaaaatgccagcttcacttacgaatgtccttgataaagcagaaaaatattaatctcatttaatcttgacccctgaatgcacatctagtttaatattccatgtgatgaaatgggaagaatgcataaaggcctgttgtatgctgaagtgcaatggttgactcaaggaaaaacgtgtgtgcctgagttacaagctgctgttttcatggagtatcatttttatttggaaggacaactgacagacaagactgtggttatttgtgttatggtgtttggcagacattttcttgaaaatgcaggaagccacaataaacatacgtgtgcatgtgtctttatagcagcatgatttatagtcctttgggtatatacccagtaatgggatggctgggtcaaatggtatttctagttctagatccctgaggaatcgccacactgacttccacaacggttgaactagtttacagtcccaccaacagtgtaaaagtgttcctatttctccacatcctctccagcacctgttgtttcctgactttttaatgattgacattctaactggcactattcacaatagcaaagatttggaaccaacccaaatgtccaacaatgatagactggatcaagaaaatgtggcacatatacaccatggaatactatacagccataaaaaatgatgagttcatgtcctttgtagggacatgggtgaaattggaaatcatcattctcagtaaactattgcaaggacaaaaaaccaaacaccacatgttctcactcatagatgggaattgaacaatgagaacacatggacacaggaaggggaacatcacactctggggactgttgtggggtgggggttggggggagggatagcattaggagatatacctaatgctaagtgacgagttaatgggtgcagcacaccagcatggcacatgtatacatatgtaactaacctgcacattgtgcacatgtaccctaaatcttaaagtataataataataaaaaaaagaaaaaaaaagacaaaaatactataataaaagatgcttctatcacacacacaaaaaaagaaagtgcaggaagcaaaacttcaaggaaaacaactcatggtattttttgtaaatggtaaaatttgatctttcatgggaaaaccagaatttttgaaaagttgtatctgctaccatgagcttgacaacctcccagtaattaaaatatttctgatgaagttggtgaagatagtaagtaatgtgattttttttgctattgtatatgaaatgtgtcaacatttgaaagatctttataactcagtaaaccaatattttccagtcgacctacattgcattatacaataatgctgggataaaagattcattgaaagtataagagagaccagtggatttcagtgtagcagagtacaaaaaggtcattgatacgatttcagattccacatcatagttaacctttaagaaactaccacttgttgagttttagtgtcctgttgaagaacgtctaccattatctgaaagagctattaaaatagttcttttctaactacagatctctgtgaggccagattttctttgtatacttgaaccaaaacaatgtattgcaacagaatgaatgtaaatatagatattagaatctaggtgtcttctatgatatcatacattaaaaattttgctaaactgtagaaacagtgtcgctactctcactaaatttgtgttggttttggaaatgtttttaaataatgttatgtatgttagtatgtaatgtgtttattattaccttcgaagagtagatattttttgaataacaactgtatcgtaaatattaaataccaatagggataacccatatcaaccagagctctttgggatcctcagtaagtgttagaactgaaaaggagttctttttaagagttaaacgtcaaaatttttgatactaaaaactttgagagccactgatttagtgctttatacaaagcacttgttatactcattatcttatattcgtagccaccttatgaggtacatattattgccctaactttatgggtaagaataccatgacacaatgatgctatgtatatttttttagcaacccctctgaatctcatgatcttcccagcgtagttttctctctgggaggcttgcttccaagtttaattttgtaggtccagtcttcttacaaccctcctcccttttttccaatcgaagtttcttatgttatttttcatagtacaaaaacagtacacgtaccttacagaaaactcagatatcataagcaaaagagtataaagactatccttaatcttcccgagtggagacctgttagctgctcagcagatatttatacagatgcttttctaaacatgttcatttatcagtgtaaagccggtatagtataatactcaattagaaggattttggagtcaaatggtttgactcccaactctgagctcttagacaagttatttaacatctgagctttctgttccttatctgtaactgcactgatctgtttttctgtgtctagagttttgccctttccagaatgtcaaataagtagcattgtacactatcttgtgttttccatctgaattattttacttatagtgcattttagattcatcaatgttgttgttgtcatccatagtttgttactttttactgctgattagtattccattgaacggatatatcaaaattcagttaaccattcaccagtttatggatgtgtgagttgttaccagtggcaattatgaataaagcttcttggaatatttgaatacaggcctttgtgtggacatacgttttcctttttcttgagtaaaatacctaggtgtgggattgctgggccatagaataagtatacacttaactgtataagaaacttccaaaatgttttctaaagtggctgtactattttgcattcccaccagcatatataagagatctagtgtgtgtgtaatcttatctcattgtcattttagtttgcattgtcctaacatctgaaaatactgagtattttttgtgtgcttatttgctttttgtatgccttctttgatgggatgtctctgaattttttggccattttaaatcgggttgttcacttatttttttagttgtaaaagtcctttttatatactggatacaggttactttgtcagatacgtgttttcagagtatggtctcccagtttgtggcttggctgtcattttgttaatgataggtatcttttggagagtaagagtttttcattttggagaagtccaatttcatatcccatctaagaaatgtttgcctaaccgtaggttgcaagtatttttttttcatatgtgttttggacattttatagttttgtgtatgacatttaggtctatgatccatgtcacataaatttttgtatatgttataaggttaagagtcaaggtgtactttcctcatttatccagttgtaccaccatttattgaaacataattatttctccattgagttgttttggcacctttgtggaaaattaactgactctatatgtatgggtctgttttccaactctctagtacgttctatatatctattcttatgccagtactacattgtgtttattactgtagctttatagtaagctttgaaagcatgtagtataaattgtccaactttgttctttttcagaattgttttgcccattctaggtcctttgcactgtcatatgacttttaaagtcagtatgtcaatttctacagaagaacctgctggctcccaattttcgctgggattgcattgattctttaaaataatttggttaatttggtgtgtgtggtaggctaaatcatgacccacaaagatacccacttccatggaacctgttaaagatcttgagatgatggggttatccaagtggggcaataaatgcaatcaatcacaggttcccttaaaagagggagataatattaagaggagaaggcagtgtggtggaaacagagacagagatttgaagattttatgcagctggttttgatgatagagaaaggggccatgagccaagggaatacagctctggaaactggaaaaaaacaagtaatagattctcccatagagtctccagaaggagtaggtcctgctgacatcttggttttagcccagtgaaaccctttttggacctctggcctcaggataataaatgtgtgccattttaagtcaccaattttgtggtagtttgttacagcacccataggaaactaatacacagaggatgtaaatcttaacagtattgagtgttctatgaacacagtatatgtctccatttatttagatctttaatttttcttggcagttatgaactgaatgtgtccctttaaaaatcacaagttgactctagtccccagtgtgatggtatttggaggtggggcatttgggaggtgattaggttatgagggtggaaccctcatggttggaactagtgcccttataaaaagagaccagagagctaactcactctcttttcaccatgtgaagggtattgagaagtctgccatctgccacccagaaggcagccctcgccagaacccagccatgctggcatcctgatctccaacttccagcctctggaactgtgaggaataaatttctgttgtttattagcttccccacagtcctaccagtgttttgtaggtttcagtatataggttttgcatatatgttgttacatttatccctaagtgttttatatttgtgatgctattgtaaatggtggattttttcataaacttttaatttttgaatagttataaatttataggaaagttgcagtaaatgatacatatttttaaatttctgtttccaatttgtgatagctactatatagaaatgcaataatttttgtaaatttaccttgtgtccttcaattttgttaaattcacttactagatctactagcttttttttagattacttaggatttcctacagggaatatcatgttgcctatagataatgacaggtttacttctttcttttaaaactatattcttttaatttctttttatcatcttattgttgtggctaggacctttagtacaatgttgaatagatgtgttgaagtggacatacttgctgtgtttcctgtcttaaggggaaagtattgagtctctcaccattaagcattataactgcaggtttttcatagatgctcttcttttcctaatttgtttaacgcttttaacttgaatgggtagcaaattacgtcaaatgctttttacacaactattgagatgatcatatgatttttctttttcagcctgctaataccacgaaggttgctaactgattttcaaatgttaatccaagattgcaatcttgcaatcctagctaaaccacacctagtcgtaatgtagtatccttatatattgctgaattcagttggctaaaatcttttcaggatttttgcatctctgttcatgagagatattggtctgtagttttctttctttgtcagttttgttatcagggtaatgctggcttcataaaataaattgggaaatgttcccccctcatcttttttgcaagagtttgtgaagaattggtggtatttcctcattaaatgtttggtagattttgccatggcctgacattttctttctgaaaaaggttttaactagaattgcagtttccatgtctttgtttcaagaaatttcctggcataaagttgtttataatatcccctacttatccctttagtattattaggatttgtagtgatatccctgttttcattcttgatattagtaatttgagcctactcttttttactgattattctggctgtagatttaccaattttcttactttctcaaagaaactgcttttagtttcattgatttttttctctaatccctttttactgtattttattgattaatgtgcttacatttatcattttcttctttccatttactttttaaaaatttccttccgtttcttacatggaggttccttacctccatgttctttctagtttcataagatagaatcttagattattgacttgatatcttttctaatgtaagtatttgatgctaaaatttcccttaagtactgctttagtgtatctcacaaattttggtatattgtgtttttgcctttagtccaaaatatttttcaattttcttcatagtctttgacctatggattatttcgcagtgtggcatttaattttcaagtattttgagaattttccagatatttttctattgttgatttctagtttgactccattgtgcttgtttactttgtatgatttcagtccttttaaatttgttgagctttgttttatggcccagaattcaatctatcttggtgaatgttccgtgtgtgtttgaaaggaatctgtattttgcttttgttgggaggaactcattaatattaattaggtcaagttggttgatagtgttgctacaatcatatatatccttagtaattttctgtttatgtgttctattagttactaagaaaggaatgttaatttccatttataacagtttgatttttttatttctccttttagattgatcagtactttctacatgtattgtgaaactttgttattaggcatatgacaaattgacccctttatcattatgaactacctctatttgtccctggaaatagtccttgttcaaaaatatactgtgtcttatgttgtggtaggcagaatgccccacccccacaaatacacagatacccaggccctaagccctgaaacctgtgaatatgttattattttacatggcaaaggggactttgaagctatatttattagcattcgtttctgctgttaccatgacaaattactctcagttctttaggtcagaagtccgggtacagcacaactcagatgggtcttctgcctagtttcacagggtcaaaatcaaagtgtcaggagggctctattcctttctggagcctccagggattaatctgctttcaagcacatttgggctattgtcagaatttagttccttggggttgtagggctgaggtcccatttaccttgctggctgtcagctgcgagttattctcagcttctgaagcctgcctgcattccttggctcatggttccttacctccatgttcaaagccagaagtaacaggctgaatccttctcaagtctggaatctctctgacttctgcctcatctctcttccaccacatttctctgacttactcttctgctttcttaagggcttatgggattacactgggcacacctggataatccagtataatcttcctattgtaaagttagctgattagtaaccttaattccatctgcaaagtcccttcacagtattactcagattagtgtttgattgaataatcaggggacaggaatcctgggaaacttctttagaattctgcctaccaaccacagttatggaccttaaaatagggagagtagcctggcttaaccaggtggactcagtttcatcacatgaactcttaaaagcggagaactttctctcagtggaagcagaagcgatatggcagaagtagtgagaaaacatcccaagcatgagaaagattgaatatgctatagcttgttactggctttgagatgtaggggcctatttacaaggacccaggagaggcccctactatcgcaagatcagctgctgcgtgacagcaagcaaagagacacatacctcagtcctacaaccacaagaaactggattctgccaacaacctgaatgagcttagaagtagattctgccagagtcccctgataagcattccaccaacagacatctttatttcagccttgtgagattctgagtagagaaaccaaccaagcccgtctcgccttttgtcatatagaactgtgagataataaatttacgttgttttaagctgctaagtttgtggtaatttgttacagcagcaatggaagactaaacagatattaatatagtcattccagctttcttttggttagtgtttatttggtataactttttctttccttttgcttttaatctatctgtgtctttatagatagataaagtgggattcttacagacagcatatagttgtcttgcttacttatccaatctgatcatctttgtctttcagttggccatttatatttaatatagttattgacagggttgagttttaactgttttcttgctgcagcctggaaactgcctctgatctgcaaactggggcaatagtagggtttacctcctttatttcctccttctcacctgttctccactgcctgttgtcaatgtctgaaaactgttcttttgtagactgtatcaagcttcttatttaggcgggaaggtaaattatattcctattattaagtcaaggctggaaatagaggtcctcaagagtataatttctaattatttcaaggacatcctctgtagcaattcccttttatatgagacgtgagcatgtgtgtatgtgtaatttattcattcatggaaagtataatacatacactaaaatgttcatgccatatgaatatgacagatggctgcctttttagaaatagaatcagttagtgatagaacttgaccattttcagagcatgtcagccttttccagtctctgtgtcttggtatagctagttccttctgcctggaatacttcctcatctcacttgctttcctgcctggcagcttcctacttgccctctggaaccagctctagggtcaccacatctctgcttctgagtgcctcctcagacacagtctgtatttcctcttccaagctctcatcacaaacattgtgctgtattatatgtttctgtgtggtcttccttctatgaggaagccttggaaagcaggagacttattttagtcttctttatgtttcttttattcccaacacattatgtctgccccatagaccttttcaataaatgattattgagttagtgactccttttacatgctgacaaatgtggctcttattactccccatttcagtatcacatatttgtaaaagtgaatccttcttaatcgttttacttttctcctagtaaattcctcatctatgcctgtctgctgctgttctctgtgctgctggcccttcgtttggatggcatcatacagtggagttactgggctgtctttgctccaatatggctgtggaagttaatggtcattgttggagcctcagttggaactggagtctgggcacgaaatcctcaatatcggtaatactgctttatacaacccattggtctctagcatgagggagcaatatcttgacttttctcacttttgatgaagtaaggaccattttattttctacctatctggggtcttagaactatagtataagctaacagatctcttctgtgtttttgaaaatttagtctttggtatgtattttcttacaaaagcagtgccatttgggggtaagttgccagccagctcacagatgcctatataatccaaaatgcacccaaaatacagaactggtatgccatactagactaagcagcatgaaaccaccctgtttttaggaaaagacactcatattatgtttggtcatgaaagatctttctccaatacagttttggaactggggctccccttgtcccaccctcctagtcccagagctttaggactattagcagtgtaggggaggtggcttgaccaggagaccatgagtccctgagacagcagctggggaatgaggaaagtcaaagattggatgccgagaaggaaagcagagcctttgggggcaggggagaggggtaccctttaccgtttccaactcttgccctccctgctcttggatgcctccgctggcccaaattcctgggagttggctcacgccagcatgcaacctgcttgttgctgggacctgcgagaggctttcccttctctgccacagagactgtaactacataaagggaaaaagggggacttaagactgggaggctattatgaacctccactgggaaaatgaggagtacaggaattcccagaaggcagctgctcatgtgggaaaagtgtaaagttgaaactaccgcaccttttttttttttttttttttttttttgagacagagtttcgctcttgttgcccaggctggagtgcaatggtgtgatctcggcccactgcagcctccacatcccgggttcaagtgattctcctgcctcggcctcctgagtagctgggattacaggcacctgccaccatgcccagctaattttttgtatttttagtagagatagggtttcaccatgccaggctagttttgaactcctgacatcaggtgatccacccgccttggcctcctgaagtgctgggattacaggtgtgagccaccacgtccggccactacatcaactttttaaatttttgtttactaaatatgaaaatgattcagattgtgtaaattacatatcacatacatgtctaagaactgtaaaacagttacacagagagccttggcaggtgagggacattcatgtatagctgtttcagagttcttagattttttttgaaagattgatgacctgtgtggctgtatgtgttttatttttttatgagatattttcagatatctaatattaattgcttctcaaagaatgcaaagttaaataaacatttaggttctactaattgatatttagaatatattcaaacttctctttgttggtcttatttaagatgttttgagcaaggaaaggaattgtgtatgtggggttgaatgtaaggaatgtacaggcgtggtcattctcatgttaacattaaccagtggaacatggttgggtcctacaggaataacctctgatagcattttctctatgatctaacttccggtgtatttgtcacccacaatacatgtatatcataaatgttcatctgtattttgaataaacattgtaggcctttcagatgcattatagagccttttcctgattagcggccttaccattgctcaattgtagatctgttaaggttattgtgcatgatacttagctaattaaactgattttgtttgagaacagttttaactcttgttcttctttctctttcatctgcaggtgttaatttatcttaatggaatagaaaggaaaatgaaaatcatttatacgttttatttgcatttaaaaatagcacctaacaatagttactactatcttgaaatataactggcacttgttcatagaactagagttatttttataatattgtgtgaagggtggtttacatggtttcttgaaaaatgaggatcatgagacttaaggggtatttgcctggttttagcagcagaagcaaatcagcttgaataatcttggaagtaactcttgttgttgaatttaaagatgtgaacagaagtgtttatgtacattgtcagggaaataagaactggctattacttttgagaatatccttatacggttaaaacattaaattctggtttggttgtaatgttcattttgtattatgtagtagttcttcgatgtttcagagattgcctaccaaagcttaggtttaagttagctttctacctgatttccctttgcttttgtcaaattttcaagtaaaattcaaagtataaatataagttggtatttgccctgaactgcttgcttatagtggagattctgaactgagggtgttttcttcttctctcccttttttagagcagaaggagaaacgtgtgtggagtttaaagccatgttgattgcagtgggcatccacttgctcttgttgatgtttgaagttctggtctgtgacagaatcgagagaggaagccatttctggctcctggtcttcatgccgctgttctttgtttccccggtgtctgttgcagcttgcgtttggggctttcgacatgacaggtcactagaggtgagatttcatatatttaagaatgttttccactttgggaggtcaaggcaggtggatcacttgaggtcaggagtttgagaccagcctggccaacatggtgaaaccccgtctctactaataatacaaaaattagccgggtgtggtggcatgcgccagtaatcccagcttctccggaggctgaggcgggagaatctcttgaacccaggaggcggaggttgcagtgagccaagattgaaccattgcactccagcctgggtgacagaatgaaactccgtcttaaaaaaaaaaaaaaagaatgttttcaaaagtaaaatattttgctcagttattcagatgtcaatttcttaccctttgttaggaagagcttgatcattaccaactctacatcatgagacaacaaggcaacaaaagatgatggaaataacaatttttctttcttcacttagaacactagcttttcacccaggacatcagccttctcccagcttcacatcctgtatcaatcagacagaaacagaactgataggttagatacagatatatgtataaagagagttaaggaactggctcacattactgtggggctggcaagtctgaaatctccagggcaggtgaacaggctggagacctaggaggagttgacactgcagtcctggcacagaattttttcctctccaggaaaccacagtttttgcttttaaggccttcacctgattgcatgaggcccacccatgctatggagggtagtctcctttattcaaagtcagtaccttcactgcaacagcaagcttagtgtttgattaaataactgggtactatagcccagccaagttgacactcaaaactgaccatctccccacctcagaccccatgatttagcacctcccctgctgtctggttagcttatcctgatgtgcccctgtgtttgtttattcattcaataaacatttatcaagtatttactagatgccaagccctttttccctaagcatagaggatatgcagatgaataaaataccaggactagtaataatagtaatgaaagtaattgcagataacgtttattgagcacttactgtgtgccaggcattgtgcgaggcacattacatgtggtagttttcttactaactaactctgtgaggtaggtccagagaagataagtcatttgttcatggccacatgtgaaggggcaggaccaggattccgtttgagtcagcccgactctaaagcccgggcacataactacataactgcatagaagctgagggcccaaagctgaatactgatgggttgaggggagaactagaggctgtagatgcctggttttgagccgtgtggatgaagagtgaagggagaagactgcagttggcttaggaagtaaacatagcagctgtagggtgggtcaggcatataagcctagaccccaggtatgggcgtgaggggaaggtatgtagacagagggacggtgatggagcaaggccctgtgggactcagggagaatgggacctagagcaccaggaagggtttggccttgaacaaggggagctattccctgattttcatgctggtggaaaggccacagcatgggtatagtggtaggtaggagtgagccgtggagggagagtatctgatggtccactttcaccctccctacaattcccagtttatatcagggacttgagcatccatggattttggtatccacagggggtcctggaaccaatcccccacagatactgagggacaactatacaaggactaggactgcattgggcctgaattacagaaagtaagtctttcatatattcacactctaggcattcctgcccttggaagaaacaacataccaggagctgagctccctcctcctgtgatgcaagaacagtacctatgttggtgagggggtggtctggagtaggctcatacagagatgggaaggaggagttgagggtctgccaggaagccctgtgttgggagggaagggatggcatttttgggacacattgaagcctagaggcaggaaacactccatcagctgagtggactgtggcgattcagatccgacgggagcacaaggtggaaaggaaggaactgtgggagttgagaagagagggagcctctacagagggattggggcaaataggggccacgtcctcagcccacagagcatgtgctgaagtgccccaggcaccccagtgcactcacagggcaccaggggatagtggacattttgaggaaaacagtaatacctgacatttgttgggacaccatacaaactactagcttgaaatagtttacaggtttatttttaggccacactgcattcctttcagtgacgtcgtatctttaagaagctgggttttcagcagttgctgtgaaaacaaaaaaggctaatgctgtgtgaaaatccgggtgaagaacaggtaacgagtgggagcaccttgtctgattccaaggcgtgggaaatggtgagctacctgacaggcacacgcatcccactgggaattagttttggttatttaagaataatattaacatttttctttagatttatatgaattattttttctggtggctacttagaaatacttactaagttagacgtaattacttaaatcagtgcaactgttggcattcccagccacattagggatttcttttggcctagaggtctatggaggaattactaaattccccatgtacctatgtactgagaacttttgggaagctctgggcctggtcccagatttcaattttgtgggcaagaatgtactttaccagagtgaggagcagcctgcagggcgtttgggctggaggcgggaggttagtaaggggttgctgaagtggtaggcggatggtgccgaagaaggcctcactaggcagtcatcatcaggataggaagtgggcacgggattcaggagaaatctggactttacagtggacaggatgtggtgactgaacgtgacagtgtgggaaaaagaatgcagggtgattcccgggctcatggcttgagaaatgagaccactgttgtgcctccaagtgacatgggaggctatagaaagtgacatgggaggctatagaaagtgacatgggaggccatagaaagtgacatgggaggccatagaaagtgacatgggaggccatagaaagtgacaagggaggccatagaaagtgacatgggaggccatagtgacatgggaggccatagaaagtgacatgggaggctatagaaagtgacatgggaggctatagaaagtgacatgggaggccatagaaagtgacatgggaggccatagaaagtgacatgggaggccatagaaagtgacatgggaggccatagaaagtgacatgggaggctatagaaagaggagatacaaggttctaagtgcaggcgataatgatctctatttgggactggcttcatttgaggtgcctttaggagagccgagtggcctatgcacagctgggtctgctatgcagcaggaaggctaagttggagacagatgtgagaactaaccatgaaggaggtaataatgcagaccaagggtctggttgaaatttcttctcccccagtccagggtgcagcgggtgagtgaaaatatgtgtgtttgtgtgtctgtcttcctagtcgggagagaagactgagtttgtggctctgcggagcatcaccatttaaggagggggaaaaggagacagaaggaattaccagaacactccagagggctccaagactgtatggtgggatcctagatggccaggaggaggggagcaaaaaggaaagagtcatccacagtatcagtaggatgccagttgaagtgtttttgctgcctcccggttatcggtgactttgatgaaagctgtcttctggtggtcatgggggtggaggccagatcacaaggaagctgggaatggtagatgagatagtaggggcttgcatattcattactgtctcgcagagagaaacctgaggctaagaggggtcttggatcaaaggatggggtgggtttatctggtttcggggcttttgtttttaatgagaaggagtcatttctgtgctgctaggagggatcaatggaataggtggggttaaagatacagtacggaatctacagttgatggcttgatgtgacaaggtcctcaaggagcctgaaaggaaggggtggggtccaagggcaaaaccgaggtatgagaagaaggatgcacaaggatggtttcgagtagacagtattgttggtagggacatgaaggaagcttagtggtctattgcagctagcctgtgttcccagtgaacctggaaacaaggttctcatctgtgctcaggcctcaggccagaaagggcaaggcagcagaggggcaaggcagcagaggggcaaggcagcaggctgagccccatttccccttgccataatactgctgtgcccctctggtaccgaaaatcaggagtttccagtgcaatataatattatacaagttacactgtattataatgtgtattgtcttttagtgtgttaaccaaattactgcagtattaaatgcaaattatactttgtttaactgattcttctcttcatttttagttagaaatcctgtgttctgtcaacattctccagtttatattcattgccttaagactggacaagatcatccactggccctggcttgtatgtaacttttaaaatccttaaataaacttcttttttattataaaagtaattcatattcactgtacaaagcttggaaaagacggacaagcagaagtaatagcctaatagtcacccataatcccaccatggggagataacatggttagtgtttttatgtctgtgttttatacaaacagtttggatataactgtgtgcaccattttgtatcctgatttttttgttttaatgttgtatcataaacattttatcatgttaataaaaggtctttataaacatgacttctaaagtttaattgatacaaaatattcttcaagtgcatgtatcagaccatcctcttatttctaaaatatggtatttccattgttgccagtgttgaatgattttaaatcatactgcagtatatatgtttatgcattaaaatttttgccttttgttttttggttgttttcttaggaaatagtccagaaatagtgttactgagctagaggttgggaactatttgagattcctatatacgtatactgcactgccaacttgcttttccaaaagccatacctggccaggcgcagtggcttacacttacagtcccagcactttgggaggccgaggtgagctgatcacttgagctcaggagttcgagaccaacctgtgcaatgtagcaagaccctgtctcaaaagaaaaaaaaaaaaagccatacccatttacactcttgctggtggtggcatctatgtcatgcttctaaactgtgacttcagttactgggcatttggttgaaattaactgtgaataaatgggtagatggatgcagagatagaaagataagtggcaaggtagaaattagagaacacagtatagattccactattaaatgcatggaaaaaagatggagactaaaggcagaagagttccattgccactgggaggtaaggtcatgctagtgtttttgttcggttttattttctctgttgtttgatgtataattttgcatacaatatattttatgtattaaatatagctacccttaaaaagtgaaaagtatagtaaagaattgggagcagagaagaaatgaagggaacctaagtatactccatatttaaagatgggaataatcacttctgcccaaagtctttgataaaacattcataataaaaaatattcagtcactcatcctacaacttcacagtgctgtatctggagaatggtcattgggttcaaaactgtttctgttgtgacgtgaaggaaacatatctaaacaagaccaaattttttcgtataagatactgtcagggaaaaaaaagattagtaattttgagagctttccacaaatgagaagaaagattttttctgcccttcatcctctgtagatcccagttgatgaagcagtctgagtacatgtttcccatagtgagcaagagaaaacaaggaagcctattgagatctaacattccacccatgaagggaacttcagtaaaaaggagaatctcatcacagaatggggaacggggaagaaaggctgtgcatagactctgcagagaaacctacaatcaagaactggtcaggagaagtaaaattcgtatgccaactcaaatcatagatctaaaagaaaatgtaaaactatagatctgttaggaaataacataggacagaatctttggggtttgcaattaggcagagagtacttagaaatggcactgttaatatggtccatacgagagagaaatcataaatttggacttcctcaaaattaaaatgaaatgaagacaggccacagactgggagaaaatatttgcaaagcacacatcaaaacactgacttgcacccagaacatacagagaactcttaaaaactcaaaactgcaaaaagaaacacctaaaaattggcaaaagagttgacaatttgcgaaggggatatacacatggcgaaaaagcacaggaaaagatgctcaacgccattacaggttagggaagacaaactacaaccaggatgagggcccgaaacacatggcttcagaatggtgaaactcagcaacactgacgaggccacgtgcctgggaggatgcagaggaactgggacactccagtgttactggcgggaaggcaggtggtacgggcactgtagaaaatggtttggccatctctgatgcagttaaaagcgcacttcccgtgggacttggctgccccactcctgggtataagatttacccccagagaagtgaaagcgcgcagccttgtagaaacccacacaccagtgtttgtagcagtcttgtttgcattttggatagcggccttgtttggttttcacaaaccaccctcagcggacagtcagataaactgtaggcatccatacaatggaataccactcagaactgagagggaacgacctgtggatacagggagggaacaacttggatgaatctcattagagacattatgtggatggcgggaagccagtctcaacaggttacttgtctcgcgatgccatctacataaagttccagcagagacaaaagtacagtgacagagaacagatcagtgtttgccggggctaatggtggggacggtgtgatagtgaagggacagcacggagagttttgcagggtgacagacctcttctgcatcctgccaacggctgtgcgaatctacttgtgtgaagactcagggaactcacaccaaaggaagacggtcacttttcctactgtatgatagataattaataaaaagggagaacggaggagtgtcgtcccaggaggcagggcaggagggcgaagacgtgtcacaggggagcctggccaagtggcgcccccggaactcgtcctctgggcttgtgtgtggatgagacaaggtctacctggtacgacagggacatactgggaatgcgcccttgccgtggaggcggggacccggcagcgctacgtatccagcatcaacctgtatccagcatcaacccgccaagttcactaacttggtaggggtgaggttagggatccttaggagcccaggcagccagactttctggggagcccattcccatttgtgttgccaaagtacccccagcaggttgtgggaatgttgcctgtgaagagagtctgttggggtgagatcttgtgtgtgtgcacagggtgacagttgtgtcccatttcccgggaagctgtgatggcagcagaacctagaggagcctgagagagtgtgggagagtgggcctctggaagagtagaggctgcggagccaggtgcagggctgtctgtcacccaaaggaagagggactgatgactcactgagcgtgtgtgtcccctggtggcagcaggccccatagtgaacataccataccttttctgtcctgagcgatgctcccagcagtcctgggagatggaacggtccttattcggctcacgggaaggaccgccttaactggacagacacagcaaggtgctaaagatgccttccatcagaggccaggttggaagctctaaagagacttctcttgctgttctctcacccacccccaggttgtgtgtgtcccgctgtggattctcatgtcctttctgtgcctggtggtcctctactacattgtgtggtccgtcttgttcttgcgctctatggatgtgattgcagagcagcgcaggacacacataaccatggccctgagctggatgaccatcgtcgtgccccttcttacatttgaggtaagcgttccacgggaagcctcttcagcccctgaagcttgcgcttcccctgacaggattctgcacccctagaaaggcagcctctgtccctcgagctcacagtgagcccactccaggagaggggagagaacacagccatctccgagagggagcttcggtgaaaggagagcatccttcctttctcttgggggcagcacgtggggctggcagggagaagagtgcacctttttagccatggtgcctctgtatggctccagtttccactctggggaaagcagagtgggatgtcagatttgtgtattggagtcacgtggagaattctagaatgggagctgttgactccttagaacaaacacccggaggagtttgccataaaactgctggcactgggaacttttcaagtggataggctattgccgagctctgaagagggacataaaagctcatttcgagctttccccagggataggtggtttcctgcctttttctggcggtgctgatgttccctcttgtgggagctcacgcgggggtggggtggtggggaggaactgcctaatgaagtctggcttccgcctctgcccattttcggtgctggcatcaaccgggactatgtctctttctttagattctgctggttcacaaactggatggccacaacgccttctccagcatcccgatctttgtccccctttggctctcgttgatcacgctgatggcaaccacatttggacagaagggaggaaaccactgtatgtactcagcatttcagaagtccttggtgtgtgtctggggggggaccagggagtgggggggggggcggatagaagtctaggaagggatgagtccccgagggccccaatttagaagcttgtgtgggaaagtgagggctgaggaaattctgggaccttctaagggaagggcatgccgtaactctggtgttctgctggcctgcaccgggacttttctcgcagtgcacgctgccatttgaggtagaaccagacacggcaggcaacctctcagagatcccgttccctcctctgcaaaatggggatcaagacagattcttcccaggcccgggagggtttgatggaaaatccacatctcccacccaaacctgggattcatcctaggtccctgttggcctctctgcctcccccatatccttgctgccatcacccgagtcttgcctgtcttgccttgctaacactctattcccctccacctgcttgctgaggcagacacttccaaaacgatctctgcagagggtgccttcctggcaaggctgtgggctccatggcacggaagcccagagcattgcccttcggaaagccagtgggtttgggggcagggcctcactgcagcccagcagcccgggctgtgcttgctgtttgtgcctctgccccctaccccgcacccgggagcagggagggcttgcaccgagctgacactccagtagcctacagagaggagtagtgggactgggaaagtggctttaaggtggctccatgagttcaggccccctcctggccaggacccgtgcatgactaccgccctcacggattccagagggtgacagaaatcttgttcttgggtggcactgtcatccatgagtttatcctggctggagaagattagcggaagacaccgtagtctgcgcaccacagatattttgagactcactggagcagtagttctcaaacttgggcatccagcagaatcccaaaagggccaggaaaaggggaccgctggagcccaccctagcccgactcagtttctggaggtctgggctggggcccgagaatggcatccctaactaggccccgtggacgctgtccctgccggtccgggaaccccactccaagcaccacagagctagcatttgcacttcttccccattttgggtactcaagccctgttcaggctttgtgactcaggagtctggataaagtatgttatgacattgtaggagtgaaacttcttgttacggaaagaaagttaacaggaaggtcagttgagcctcgtgtgtgaaataaaaaattcttatttttcagggtggtttggtatccgcaaagatttctgtcagtttctgcttgaaatcttcccatttctacgagaatatggaaacatttcctatgatctccatcacgaagataatgaagaaaccgaagagaccccagttccggagccccctaaaatcgcacccatgtttcgaaagaaggccagggtggtcattacccagagccctgggaagtatgtgctcccacctcccaaattaaatatcgaaatgccagattagatgccacttccggggacagagcttaagtggactgggacgcactctctccgccttcctctgccccctcgttcaccccgcagaccagaaccagtactggagctgggtctccaggtacgtccatctcatgccttgtttgcatccagcgcctatcagccactcaccacgacgggacgcggaagtggcaggtgacgggggtgtgtgccagcagatgcggatgccaggaagagtgtgagaacaggggtgggattaccgtctgtctgggaggggctccaggtacccctcttccccgtcagacccactgggagatggctgcttgccaggcccccagaaggaacatctgtctatacggtgctgaaatcccaatcaaaagtattgtttagaaatgtatttctccacagggctgacctcctgcagctcgctgagcactcccaggtcctcagcactcccaggtcgtggctggggcagtcagtaggaactgtaactatgtctctgatgcaccacgtgtttagacacagcacagtccttttttctgttcctactgtggaagtagtttctctttgggcatgctgacagcagtttttcatagcctcacggatgagccctttctacgggagtgactccatgcttgtatacagagtatttatacaaatgttttagcatcttcatatgcggtgttaacccctagttctgtacagcatattctgttcaagtatttttttacaagcttgtgctgtaggcacatgccttctgctgcagaagtggacgcccgtggcacactccccccccccccgtggggtgccacgccttcatgggacattgccacttctgccctggaactcgtgcaggtacgtagtagctgctactgccagaacggcaacaccaagcaagagatggtccatgcttttctgacgttctcagaatagtggctagcttcaaacctgacaagcgctgcttgaagccggaacactagagaatgttgctgagagcagaaacggccacgcgggtcacgactatgcgtgggaaagtctcaagcttccctcctgccagcaacaagaaggctttggagtaggcatgatgttttcacgtgtgcgtgccgtttctccaagcactgcaggttccaccgtgtgtcagaggctgcaagtttaacatcctcctgcctgaaaacaaataggtcctttgctgaaaagagggtaaaaaaagagctttgatcttctcagccaggagaagagggtggtgttttcacgcgggcaactgctcgccggcctacatggggttaattcaagtctgctgcgagcacgactccgcccttggcactggcctccagcaagccctgttctctttggggtacaggggaacgggatggtttagactttcctgctcagtgtgtaaaaaatgtagctaaagccactatttttgctctccttaagctgttcaataaaccggttcctcattttacacgtg

SEQ ID NO: 1024 - DNA, 11532 bp, mus musculus
ccggctccgcgccgcgcgcccggaaggtggagtttcgggggtttaagttactgataggcatttctcactgctgtgtcactcggggaggaggagacacgcacgccgcacactcacacaccctcacactcacggcgacgagcggctccggccttaaaggggaagccgcgctgccctgcccgcgaccccgccagcccgaagcctggaaactcagggtttccactccgggatggggcagcgggcagccaaagagctgcggccgcccgaggggcctcccgggccctcccaccagtctttagaggagaaagcggccgcaggctggcttcgctgttgcagcctcatttctccagtcggctcgaaccagggcagctggggagggatcggaggggcggaaggggcatcggtgcactcaccttggctgctccgcactcagtggagggtggtctgtgcccccggcgtcagctggcttgcctaggcggtgcgctggtggaaagaggcgacagcagggttagcggagcgcctccagcagacagagcccgccggagggccgcaggcggggcccggcgcgcttgggaaacccgcacgccgaaggtagactttccgcgtctggggaaaacgagctggtgagccgtgcgtggccgggacacacgaagagcgagcacggagagccaaaagccagcggtcatcagtgacagggcgagagagcgctcaggaccgagagaccaagaaagacaggagaccgtacgagacacagagaaggcagagactgagagacagataccgagagaggcaccggcggagatagaggtagagacacgatgaagggagaggagaggagaggagatgagaggagaggagaggagaggaggaaataaggagaggaggagagggaccagagaacaagagagcttgcaagaggaatgacagatccccagaggaccctgaagtgtcacagggacgggagtctcatcacaaagtagcctattcagcccccatcccccttcccattttcaccagagcctgaccctagggctagcggccaggcccttctcctcccctcgccctgggaggggcactcacctgcagtgggtggctgctgggtgggtagcgccagtccctccgcccacgcatccgctcaccagctcgcgccctgactgccaaacagacccgctgtggcggcagcggggaccagggctctcaggtggcagttagtgaactgcattctctccatcccggccgagtgccccactccccacttcccagtcccccacccttagcgcggacgctgtcggcgtcgcccgccagtacgcttagctcagagtccaggctcgctggccagtctcccgttccactggaccagggcacgcgatgctcccgcccaagctgggctggattggctccctccgcagttatcccaagacggacacctgcggcttctgcaggaacataggttccttgggaactgccgggcgggccagcgcgccctgtccaccatctgccctggcgccgagtccagcgactcccctcccacctatcccacctcccgggtatttggctgcgccccttctctaggatcccctccccggatgcgtttcctaacctggacttctccagccgatggcagctgcaggggctgagcacaacccgggaacgccgcgtctgctccgacagcagcagcgctcagctcctgtccgcacctctgagtagcaacctgtcaccaacacatctggtcacgctcagcggagccgcaggccacgaataaaggggtgggcccgccgcccactaggcccctccttccctccacgcccacgctctcggccctcggaaagcgctggggccacctccgagaacccagcaagatcccttcgtgggctacgtaggcgcagtgaggctgggcgattgcctcctagcgtttcacgaagttacctggagaaagagcggcgtccaggcccaaccgcgaggcacatgcaggggctgtggcttcgcagccccagcgctgccaggatgcgcccagcccaacagggcgaggctgggggtacacagttcgtcagggcagttgtgaaggaatccgccttgtctgggtccagtcccgtctgctctgcaaagggcaagcagccagaagaggttattgctctctggtgactgaaccttaccttcaaggccctccagggagagctagagtcatctcagggttgccagtgccccggtagaactgcgagagtgcgggagtcccttgaaggaaatctgattaaacaaagctgaatgggagatggccatgcctatcacggagcattggcaggatgcttttaaaattctatctgcaacctccaagtgcactagccaaggagatggaaggtgggtttccgttcccagcacctccactcaacccttggaccacttgctctcatcttcctcagtgggacaaatgatgcccattcccctagagcatcctaagaagcctgtaatatcacagccacacgtctgcgagatggctaactgcctgcttggcaccagcacctggatggccattagaaatcgcaaactccacataacctgactgaaccgagttcctgatcgtctcccaagtgtgccgagcccatagtctgctacctcagttcatggctactccatccttcacgttgcccaggcagaaggccctgggatcctccccgattcttctctcttgctcacacctcacagccagtccagtggacaattctgccatctgcatcatcaaaatgtatccacaatgtcagtctgctcatccattgctccccccgggtaccagccagcagcctctccccccaggataactccagtagctgccgcacagactgccctcattcctccctcccttcaaccctctccttgcagtctattccccgatctctgtgccaaaccccacagtgactccccattgcactcaaagtagaactgaagtgcttctagtggcctctggggcccttcaggcatgtccctccactatctcaataacgtcatcttccctccactcactgtgctccagccacacagacctcccaactcttcctcaacacatagatacattcctgctttacttaggacttttgctttagctgttcccttgggctggaattcacttccccaagatatctatgggctggctccctcatttcctttagtcttgacacaaatgtcacctggccaccctatgtaacatttcaaagccccacgcccatctctggcacttcctctctccttcccagctttgttttctctttagcgcttaccgctagctgacctcctctataggttagatcccaagagggtagcagtcagcgtctgttttgttcactgctgtcttcccagctcccagcacggtgcctggcatggagtatctgttcaatgaatgttagtagattctgctttcctggaacttttcaggaaactctgggggccactgcactgtacacacccactggaaaaggggcccatagatgtcatcacatttgaaggtggttcatgacctaaacaaaggttaagaaggctagagggcaggcaaagagctttgtgttaatgacatgaaaccagcttcgggtcatgtcaccaaggggcagtgtggcacacatgcattggtggcagtcttacaggcagtcacaaaggtacagagagtgattccttcagttactggtggaaagaggtttccttgtggttgtcacctagggtatcccaaggttgatggacaaatgggagaggaggccggagacagaggcagggtgagggctttctcttcactgagtagactggctctgagagccagggcccttttttcacccaaaatgcaagaccaagtctggagctcagcagcacatcttcctccattaacgtagaactagcctgtgctttacgtgcagggtccgtgtccccagtgaggtgttgatcattatctccatgttctaaatgaggaaatcagacactcagagaggtagaggcacatatccaggggcacacaacccatgagtggtagagcagtaaagcaattgggcctcaaagcttgggccatttccacttgctatgtggccacccatgtttagtgtgtgcagtcctggcctgtgggtccaggcaaggaaaagaataccatggggtttcaaggagctgtcctcctaggggaactcctggtccttttgctgagtggttgctaaacaaaaagctgggcttaggctattggggtccagagataccatgccggggctgatatgagccctgtctttgctctgacccaaacctggagctcaatggatttgaaaaatacaatcatcagccacctgtcatttatagtcatattcttgtgaacagatggcaagttttcccaagttcatctgacaaatactgggacttaactgggcagcctctggaattctgggtgtggcctgcgcaggtaggggcgcatggagaacacacatgttgactggaaagaggaaatacacatccagtgactctatttctcattactcccatgctcaaaagcctcctgcggctttctactgctgacagcactaaatcccaacatctcagcttgacatgcaaggcccttcatagtgagcaccagtctctgtttacttctagattcttctcttggtactttcacacatgcacctgggtctcctgcttggctggactgctgactggacacctaacaattcctggttcttcccacttctgcccctttgctcatatattccccatgccagctctcctttcaaaatcttgcctgggttgagcacagtgtatcacgcctgcaatcccagcactttgggaagccaaagagggagaatcgtctgagcccaggagttcgaggcaagcctgggcaagaaagtgagatcccatctctatatatataaaaaaaatcctgcctggccttcaaggctcatctcaaaggccttctcctcaatgaagcttgtcctgagtcccatcacagcacaggtgccctccctcctttggacatcctcagccctagctgtccttttctgacaccgtaggcctttgtcctcagctcttccttgtttcacagtttaacagtgctttttggggtttccccaaagcctccctgatggacccatggctaatcctcagctgcagtgggtgtgtgtgttggggggtgttcagggtaccctctggatggcagaatatgaatccagagagagaaagtgagatgatggatgtggccagcaccttctggcatcccccacttcacctctaatgctcagaggccattagccaatgcccaactggaggccaccacgtccacctgctcccttggctcccagccccctacacccatgcctcactcagccaggcagatgccacaccccaggccctcagcaaagccagagacccccacccccaggctcttgagctctaggctcctggggcattggctcagggcttgtggactcctcatctgcacagagtcctagccccagggaacctgagttctctgaccacagcttgctggaagccacaaccaacaggaacacaggaatgaggacggacaagtgcccttgggaaggccttgggtgacgactaccccatgcagaggaagtgcagtgaacttgatctgggaggcaaaaggcactggtgtacacccagattctgctgtctcccagctgtacaacctcctgagcctcacaggtctcatttccaaaatggagtcacagtagtaacggccttattggtgtgtagtcagggttttagttctgtcatggacaggaccaccctagtcaaggtgtctaccccatgagtcattagccctcagagaagaggatgctatcgtgattgttatcctacataccctaaaagacaagaggcagccagccttgaacctaatcaaatgaaaagtattcggacaaaagctcaggtcttgcatgtacgttcaaaacatcttgtgatattgaacactctgcaagtgcttgatatgtctggcaaaaaaaaagatgagcctgtgccaggtaaggaaacagattggggcactcacagaggacacatcggcattttgccccggtggggcagaggagagccactgggaaacaagttgacttatttctttttgctgtgttcttgaacaattttaatattcttggggatgttgaagaaacacaatagaaacaaatgggaaatggttaaaatattgattgtaatttcctggcgacttcactgatttaaaatacaggaacctttaagaaaaaaaaaaagccctcattagcaagcaagcagttaattaagggcctgtagaatggtttgcatcgatttcaccatgaaaccagaaaactgtggctacaagtcaatttttccctccgtagctgcttacttaccatgaacgctgtttccaaaatgccataggtaatgctaccaaagcctagataaggatgggatatggtcatttaaacagagatggataaacagtttagggaattaatgtaaatccagatggctgccagtttcccacttgcaccatgcataggactgaaagacattgtcaaagctcttatatagaaaaaagtatgcagatggcatgctaattattactcttcatgcaatgacattattttccaagagaaaaggcccaactcaggacccacatgggaagaggttctacccactgttctaggacgcttcagatcatttgcaattttgtgacttaaaaagcgaaaacaacacaactctggcctatgcctgtcctagcaaccatctaggctgctgctgcaccatcactacaatcattctcaaggttaatatgacctaactccaggaaaccagctgggcccaccgtcaggcaggcacactctccaggacgtctggagaaaaccagacaatgtgctccaggtgacctgtgtttggaaagcacaatcatataagcaataaaagcagctaaagcttgagggcacacctattatgtggcaggccctgtgcttaacatctacgagctcaatgaagccttgtaaaaacacatttcagggctaagcgaactgaggctcagagaggttaagcaatttttctgagatcacacagttactccctgtggaaccaagatttggatgtcctaggcagtctggaactgagtggcctcaagagtatcctattaacataaagctcagcagggaggagggaagtaacatgtacttcacacatggctagttctgtgcctggtgcttcgctagctggcttgcatcaccttgtgagaaaggatggttacattttcagaaatcttgtcaacctgttgatgacacattggtagcctgaaattggcaatagtgggaataggcacaccaccaaaatgggcaaatgctacaaatcagggctggttgttaaatatttaccaacataccactgcaccacaggtgtcagagtcagacggcctggttcaactcctggcctcagcacttactgggtggcctggggcaagtttcctaatttgtgaaatggagataacaatagtgcccacctcatcaggttgttgcaatcattaattaatccatgtaaattacctggcacagcataagtaatcaattcacattagttgtaaacataactatactgcaactactactactactacttattattattatcatcttcattattatatttaggcagccattcactttcatctagagtacagcaaccatgtcctaactagtctcctttcttccagtcttgtcctctccaatacattctcctgacagccactagcgtaaatttcccatatacagatccttccttgcttaaactatttccttggctccctctaaccctgagggctaaagtcccacctcctttgcttaggatatgtggtctacctgacctgcccctactccaaaataccaaaatctgtcatagtttgttagggctgccataaaaaagtgccacaacctagggggcttaaacgacagacatttcttgtctcacagttctagaggccagaagtctgaaatcaaggtgtgtcagtggggtttcttctgagagctgtgagggaaggatctgtcttaggcctttctccttggctttagatggccatcttctccttgtgtctcttcacagtcttcctttaatgcatacttctatgtccaaatttctctctttcataaagaacacctgtcatattgaattagggccccatcctactccagtataaccacatcttaactaatttcatctgcaatgaccctatttccaaataagatcacattttgagatactggaggttgagacttcaacatacaacttcaacttggtacttctaaatactggaggttgggacttcaacatatgaatttggtgggaggacacaattcagccagtaacagtctgccctctggcccccaaaagtgcacatttttctcatgcaaaagacagtcactccatctccacaccccctaaagccttagcccattccagcaccaactctcagtccataatcttatctaaacatcatttaaattagatatgggtgagactgggggtataactcatcttggagcaatgtttctctccatctgtgtacctgtgaaaccaggcaacatgttctctgcttccaaaatgtcatggtgggacaggcataagacagacattcccattccaagaaggaggaattggaggggaaaaaggactcatggatcctgagaaagtctgaaaactagcagcacaaattccatttgattcatttgattttaaggcttgaggataatcctctttggcttgatgctctgtcctctgggtttgcccccgagcctctacaaaggtagctcatgtggtggacagagcaaacaagtcattgttctgaaaaacactgttctttcacacctccatgctgtgtacccgttgttcccttcaggcagcaggaggccctcctttcccctggtcagttggggtactcctctgaagtcattaggcctcagctgaagcctaaggtccttgtttgtgaggccctctttgactccctcctccctgaggcccaggaaacggagctgccccatttgtgaaaagcacctctagcatctgagctgactctattgcagccgttactaccttggcttgtaactgttgatttacccgttttctcggtagactatgaactacttgatattaagcacaagttctcatttttgtcatgtctttgcaaaatgggattgggcacagagctggtgtgcaatatacaaatgcctgtttctgtgatagcaaatgcacagaggagctttttctgaatacctactgtgtgcagagcattggacttgggctgtacactcttggaaagagcagacacaaggacaaactctctcacattcatcattagagacaacatatgtaccatacttgagagctggaagggccttagcagcaggtgctgacacctgacttattaactcattgattggatcattacaccaactctgtgagatataacatagggtagtgtaaaggcaagcaatcaggagccagcctgctttgaatccaggctttgcctcttaccagctctgtgaccttgggcagcttacttaaccccctctgtgtttttggtttccttatctgtaaaatgggactagcagtggcacttacctcacagggtggcatgaggattcagtcagttaacatctttcagatgttagctattattcagatatagccagggtctaataggtatcctagaacctgctgctgctcctgctgaaaaatgcttgctgagagcaaaacatgcttaactgctgagcgtcagggctgggcaaaataagtcctaagggcccctccagttctcctgtgaagtgctgctgtcctctatgtgaaataactcagtgcaccaacaagcaacaggtaagtacaaataaatatgtgcatgtgggaggagagtaggcccctaaagagctagtgatgcaccatgtcaggtggtggcagccccatgaacaagattctgggttattggccccatcctgcaagtggcccactgtaggacctgggacaagctcttttccctttctgggcttgagtttctggctctctcacaagcttggacctcccatttctagcattttccagggagctcccctcacctgccctggtagccaggagaccagtcctggtagccaggagaccaatcctggactgtgggtggtcgccagttgtgttggcactatagctatacccccagtaccctgcctcacagccccatagcatatctgccagcaaggaaaccctgctcccttaaggactgagtgtagatgccactcagtgaaattagagtaacaaaaccaaaggaaggaaggcaaggaagtagcttgctgcttttctctgtaagctagggtgtttgtctctcaggccctttctcctgaactaggaagcaggtgaggctagggatgctttcctccctgagtgcattctgcctgggtacttcattaagcccttaatgcctcagggcatgggatgtagagtggccctcttgctcctgggatgctgctcaaggcacttccaaggtggtactatatggggaattacggtattgggcagttgccaggaggaagagagtgtgtgccttacaaggaactgaaatgtccctgctgttcagagaaaggagattcacagaataaggcaaaatcgatgccttttgcagcagccaaatttccatctcattgctgtgtgctggagacgtgatgcccagagctggatcacacaggctggtgtcacgttgcatcagtggcaaaacaaacggctttagtaataaaatcccctggacctagtggcagatgccttgctggctaggagggccatggtgcctggctttagaaccgtggaggtccaagaaagatagacatggtgtcacactgacccttgcagtggacatctagaagcttcctataggtagccatgcagtgctcaacatccttcctgtctgtagccctgccccacagaagccatccttcccagaacacgtcattgcccatgtcattgccctggtctatctgtgaaaccacagtcccacactggcttcacattcctgaagagtgaatgtggcagtgtgccaccctataggctccactctaccatgccactccataggcccagtgactctaggagaatcagagaagaagactcaagaagcttttgcaacccttagcagaggctgagaaaatcagagcagaagcctcgagaagcttctgtaaccctaaagcagctgagaacaccaggggccacgtttttctatagtagggtaaacggcaagcagaacatttcctacccttgatggaggccagaactagctgtcccctgtcaaactccatgccaactcctgctctccgctcagggcttgttcctgctaatgaaatggctattctgccagtgtaacattacttagcgatttattagtgattattgattttcaattgtggtttccaggggctgagggatggagcaaatcgaaggcatcctgcctgtagatctacatccatttgcttgaggccatgggctcagatgcaagtagctcatccattgctgaaaacaccaggagaggaa

SEQ ID NO: 1025 - DNA, 11532 bp, mus musculus; identical to SEQ ID NO: 1024

SEQ ID NO: 1026 - DNA, 4307 bp, mus musculus
cgctggccaatcaggcggctctcgtggaggcagctagcgcgaggctggggagcgctgagccgcgcgtcgtgccctgcgctgcccagactagcgaacaatacaggtacgtctcgcaccgcccgctcccgccgccgccgccgccgccgccgccgccgccgccgccgccgccgccgccgccgcagcgcccgcacaactttccggcccgcgccgccgtgagcgcgccctgccgccgcctccccctgcctctactccccattcccttcccgccccctccgccttccctcctgctaggcggccgggaaggaagaagcaattcaggtgtttcaacttttccaacgcgttccccgagctccccgctttcgggggtcggccccctcggcggacgcccgcccgtggcggccccaggggccgcagccgggaacccagggcccccgaggccagatgtttgggcagctgcggctgcggcggctgggcgagcagaggggcggctgcgggctgtgggcgctgggcggcggcagcgggaagggggccgggagttccccggcccgcgacggactccgctggggaacgggcggccggtgcccgccgggggctgcgcggctggtgcccgccgggggccgccgcacgggcaaacttcgctcccgggcttggcccggcgccgcgcgggcccgcaggctacgccgctggctctgcgttaacatggccgtcgcggagcgcccggtggcccgggggggcgcgggccggccgcccccctctcgcctcccgcccgcccggcgccgccgccgccgctaacatggctggcgcggcgctggcctccggcgagggcaggggaggcgggcggagcggtcggcggggcgcccggcgggctccggcctcggccccggcgcccgcggcccggggcgggcggctcggagggccgggggcgccgctgcgggccctggagcggccgagcgtcatggctgcacgggcgcctttgttatcccgaggagtgcgccccgcgccggggggcggggaggtccggcccgggcccccgagcccccgggcggcccgggcggggcggggcggggcggggtgggggccgacgggcgggcggcggcggcggggcccgggccgctttgttcgccgctgtcgccgccgcccgcgccggccgcgcgcggatcagccattttagcgagtgggactccgaggcgcggcggacgccgccaccagtgccgcggctgccgccggcccggccgcacaccccccgcgcaccgccaccgccgccgcccccggccccgcgcgtcccccggggatgacagcggcggatttcaggggcactttctttcatcaggaggcttttgacaaaatggaaggtgaattacgggtgtcccggtgacccggcacgggggccgaggcgggctgcctgctgccggccgggactcccccgctcccggtcccgccccgcccgggccgccgctgcgggtctctgttgggcagcctcctgggcggctgctgccaaggggagctctttagttttacatgatgaccttgggtgtgggaaaaggaaaagatggcgggaagctggggggtgggacagggacgatgacatgccgcagctgcatttttatttggaaactttggagaaagtgttctcggctggacctgcattctgggttacagatgagcacgactagccctttttatacaccctccccctttagatagtgacgaagtgatgaattgaactaatagtacgggggtacctgctcactttccagatctcccgtgttgtaaagccgtttttttagtaagccaaaacacatcaacaatagtgacaatttcagatgtcccctacgtatagttctcctgctttggtcttgtgttcagcagtggtaagagttgttgtttttaattgtgttaacagttagcagatgaccagatagtcttaagtcatagatttcaagcttctatcacccccaccaaatgtgtcctctctctacccttcccactttgtgattgtagtttccaaaacatagcagttctgtaaacgtaacactgagtaccctacttgggtcggctccatttggagcacttgatcgcttttgagaagtaactcgcaaaccagcgcgcttcgtgctggtcaaaagttaaatgacaagcgacaatgaagctgatttctttcctactctgccttctgccactggtgtccggcattgggggaaggggacttcctaacagcaagtgtagttttagttttgctctgcctttggtacgtcttgtacttcttgtcaattcctccttgcttttcctcattgtatttctttgtttctcttttatcacagtcaggatggctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaaggtatttttctttggtacccttcaaactagtcttagttgggtttcttactttggggttacttaccttcagattttctcccagatagctgcttgcttcctcttttacttttacttagaatcatttttgcttgtcttaagaattttgtgtgtgtgcttttatttttttaaggccctgcacaggtttcaggcctttacctacccccttttgcaagtggttctagcaactgctagtttaatcacaagaaactgaataggtatgtgttcactgcatcgagggatttaacgagtcctgttctttgcagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtaagtgactataggattcaagataacaattaataccttttcttctgcttggaggatttggttttttggtcgtcctgtatttcatttcaaaatgaaatattttttaaaagatacttaaaagatggcaatacctctgcaaaccattctgtacttgggctttacgatgcagtgccagcgttgtctgtggttaaggctgaagtgtttgtgggctgtgcttgcacattcacagtggttgtctgttggcctttccattgtgaaggaggcactctagttttggttgtcagggtccttgaagtatgttctttatgcctttcctagtaattgaaagactgggacagcaccatatatatatgcgcgtatatatacgcatatgtattatatatgcatacacacacacagagcaccatatatatatgcgcgtatatatacgcatatattttatatatgcatacacacacacacgcatacatatttgagatggagtttcgctcttgaccaggctggagtgcaaggtgtgatcttggctcactgcaacctccacctcctgggttcaagtgattctcctgcctcagcctcctgagtagctgggattacagacatgcaccaccatgcccggctaattttttttatatttttagtagagacggggtttctccatgttggtcaggctggtctgaaactcccaacctcaggtgatccgcctgcctcggcctcccaaagtgctggaattacaggcgtgagccgcgcaccacatatttttctaaccttatatattttagaacctacaactttgtagcattgtatatggtatcatagattacttcactttagggagaagtcatagtggtaggagggagatgcttctcaggaatgtgggatttcaactttaactcaaattttttgtggtttctcatgtaatgtatgtaattcttccaaggtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatgagaaggtaaggtggggctggaagcctggactggtgaacaggcagtggttctgctatcagtaggttgcagggcatgtggcagctttgctgggctgagtacttagcatagcgctcaagggcccatccccctgcaaggtagctacgggtgctggtgttcatgcttttttttgacaggtctttgttttggggacaacttcaggcttgaaaaattttccttactctttaaggaaaaaaaaatgttaacagaggatttgatagtcctactaatgtgacttgaaggacac

SEQ ID NO: 1027 - DNA, 18346 bp, mus musculus; identical to SEQ ID NO: 1004

SEQ ID NO: 1028 - DNA, 4327 bp, mus musculus; identical to SEQ ID NO: 157

SEQ ID NO: 1029 - DNA, 2202 bp, mus musculus; identical to SEQ ID NO: 158

SEQ ID NO: 1030 - DNA, 65945 bp, mus musculus
gttctcctgcgggcggagcccagtccgcgcctcctcgcctccctgcgcgctccccgctgtgcaccgcgccccgcgccccgcgcctgcctccccggcccggcccggcccggccgggcgccgtccacccgagggagcccgcgccctgcgactgcccgaccctccacccgccccacgagccgggcaccggtgccaggtagggctgtcgagtcgccattggatgcggccctgcttggaggcagtggggggcacccagtccgtgcccagctggggacaagtcagggcctcagtttccccatccataacccttaccagctccaagcatctctcttcgggttccccccgggagtcagtggatttctggttttcgctgtgagtgaaaagactgacaggcagaggaggccagcgtcccctacagaggcaagtgtcccccttgccagcctgatccctctgtcttgccctttaggaaagacacggtttaattgttagtaaacggcgaggggccaggatgctctgagagttgactgcaggcctttaagaatcagggaatctcatatccctccgtccccctgtgcccattttatagatgaggaaactgagacccagaggctggctcacccagaggatcccctcaatcgccctggggcctgtgaggtgcatgtgctgggtacagggcaatcttggggagggccatgaggatggtggctgctcacactcagacagaaggcgccgaatcaggtgtcactgggtgttatcgacaggatcggcactgcaccagctctgtggctggattgttttgatgggggcagagggagccaagagtctgtcctctttggaaaggcagagggataccttgccttacaaaaaggccgaaagctcaggtgctcctgcctgatctgccacttctgagctggggacacctgggtactctgtcggtttaagggggtgacacgtcaagctgcctcccacccagggctgctggggactcagataaagtaggtggtgggtgtgtcccggctttgggacatctgaggcatggtaggagttgtgttcttgctgagccgtcggcacgaagccttggcatcatgggaggccccaaagctgtgagccccgagagagggcctctcacaccccatccagcagtgcttgaggcttcagtacctggactaagtcctgccttggtctcatggcccttcagacttctggctgtcgtacctggctgggggcgggaggcaggggtgcacaggttgataggcctgaacagagctgcagaggtcctgccttcccagggcctccgctcctcatctgaaaaacaaggggcagctcagaggccagcaagtggccaagacacagatgcacagatgaggggccagccttctggcaggccttggtgcctccgctgttcccctcatcgctcccaggccacttcaggatgggaaggaacagatccctctcacctgcccctccttccagcaattcccagcccctggctggatgctgtgcattcagccgtgtggagctgatggaaggcactcagtgcagggccagacacgcagcaggtgctcaagatctgttcatttccatcctctggacactcatgactcaagcaacagaggtggcccaggaccacttaggatgttgcagctccgagtagcatgaaaacattaggggttcctcagtcctggagcagcgaggcacccctggctgggaagatcagggaaggcttcctggaggcgaagggcttggaagcaggaggaggagctcggcagccaccaggtcaaggcccgcacgtcctttggagctgctggagtctaacctccccgttactcctgaaagatcataaaccacttcttgctgagctcctgcatatgggggcccacagagaaatcagctccatgccttgccctgaggagtgacagagaggccatctgtcagtaagaagttgccatctgaatccaaatggcagcagtgcttgtccacctcacttcctgctcagctcaagtccagactccagaaaaagcctttcccacgtgaggccagtgatgccaggggcagccagcgcctcagctcagcctccctcagcctgacttgtgctccttgtcttcctgcccagtgtccccaaggcctcctgagatctggcagggcagggactctgggtccctagcactgggcccaggacctggccacgataggcatcggcacttgttccctgaactgtcttcagttgcatgccaagcaaactcccccaattctggctcggtgcattctggaagccagaagcctgccttcctccttccctactcaagcttccacaggtgactgccccctttggtgcgggttttgcttcaagccacaacttataaggtgccaggtcacatgtaacacaagctttccttctgttgctgagccctgaggctgcccccactgccagtccctggcggcatgggacaggaccagtgccagagaggagagctgctctccagtgcggcaaccccttgcagtccgggcctttgggctctcatgtttagggtcagtccagggactttgcattcgttaccactgtgcccatagtgaaccggctgatgccaagacaagggcagtgccatcaggggaccagtccctgagagatgctcaggagaggttgccatcattgcttccaaaggccgggaagaggaggaggggctgaactgtcccacacctggtcaggtgtgtggcaggtgagggtggcaccttcatagcctagtggttaagagaatggctcagaggtcagcctgggttcaaaccccagctcagccaccatccagttgtgcaaagttcggcccttcatgcaaccccttgaggcctctgttttctcaccagtactgaagggtggctaaagccaggagcacctgctgcactgggtgcctgcaagtgctaggttcctggcacagaggtgctctgtcacggaaggtagctgagccaggactatggtgccctccttcagggctgtggtggcaaggagtgaagtgggactaggtggagagagagatgctgactgggatgtgggcccctacctgaggaaaacagtttagaaattactgctgatgatgcaaacagtatctacccacatttaaagtgactcactaaagaacacttaattcttagggtgatttctcatgcctactaaagtctgactcgctttcttttttgttttcactttttttttttttttttgttagagctggggtctcgccttgtcacccaggctggtgtacagtggctagtcacaggcatgatcatagcacaccgcagcctccaactcctgggctcaagcgatcctcgtgcctcagcctcccgagtagctggcactacaggcgagtgccaccatgccagcactgttgttactttttatctttaattttttttttttttaccttgaattgatttaaaactcatagaaaagttgtacgaatcgtgcagagaactcctgaagccttatctgaattcccgctattaacattttgccacatttctcattagctttcttcacttgtagcctttggatgggtcagagggtgggcagggctgttgtcagttcatttttccaaagggaaactgaggcacagagagggacttgctcaagtgccattgattagaaactgagccagattaacttctctcagggacacatattgatgcatttggcaggtgttttcttgatcactttctgtgttgggcgctggggcacagaaatgactgagaactgacagcaaagtgggagggacaggtctgagtggagaagagactggaaaaggaaaagacaagaggccctgtgggtatcactctcaatgtcggaggtggaatgcaggaaggaatctgcagcttaagcgtgtctcccagggaatttgactgccgaagggtcccagaggccactttcagaaacacggtctaggcttttcctgttgggagtgtgctcatttctcacctcaaaagggagctaggaactgggagggtgcctgcctggagcagggaggtgggtccaggccagccaagagagcaattcctcacccactcattaacgcccgctgagccatccctcttcccgcagagctgcccttggggctgctgctgctgagatggcggcagagctctgaagccacgccctgggtcagagaggagacatagcctctggggccagtgggcaagccctaggctgctggtggttgctggcggtggtccctggccttggccccatctgtaggcccagctcgggcacccagtccgggccccttggtctagtccctgtgatctttggctcagcacgccactttgtgatgactaggtcagtttcccagagagcttgatgtggcgaagagttgctatggagagagcaagcacaaggattttaatcacaagaaccggcatccctggtgaaaatgcttacatcaggcagtgcctgctttaaactgaaataaaaataaaaataaaaataaaacccaaaaccccaaaccaggacttgcttcaccacttgtgccagcgatcccttactcatgctttcattcctttgggcctgagcctgggcacctccttgggaaatgcagtgctctggcaacattccgctaggccgatccccccagcacccagcctggcggttagggctctgaaaatgcttgttgcatacatggcagtgtgatcctgggcaagtgctttcttctctctggacttccttattcttatccaaaaataggggcagtgttagaggtaagggtggggttgaggggactctgggtctagagtgggcagaaagatgagaaagagggttgtgggaggggagaaggaggatagggagtcagagctttgggggaagtggggaggcagcgggctctttctgttccttttgctcctaactagtgatcacctgcatctaggacagaaggaattagctttggctgatgttagtcaagggcaagaaggagtgacttcctgtcactggcctgctctggcaaagactgaatggatggcagcagtggtgtgtgtgtaggcgggggtgttcctaggggagagcgaaagagggtaaaagaaagtggccgagtgcggtggctcacgcctgtaatcccagcactttgggaggctgaggtgggtggatcacttgaggtcaggagttcgagaccagcctggccaacatggtgaaaccccgtctctatcaaaaatacaaaaattagccaggtgtggtggcaggcgtctgtaatcccggccactagggaggctgaggcaggagaattgcttgaacctgggaggtggaggttgcagtgagccaagactatgccactgctactccagcctgggtgacagagcgagactcgtctcaaaaaaaaaaaaaaaaaaaaaaaaaaagaaaaggaaaaaaaagaaagaaagaaagtagggggagagggagaggtgctgtggagattggagtgtgggctccatgacctctgagcctcctctgatctcactggctgccttgtctgcaaatgggactagcatctctgcatgactgggattggctgaagaccacattggttccctggctgcagagacaactgcaggatgaggggtacagaagcagccagggccctacaagagggtccctgcccagccctctgttctccacagagacatctccaagggcccttgaagccaagccagccctgaaatggcccagttccctgaacggtcgcttgtatctggctctctgagaacgagaaaatgggcgcatgaaagccaggaggaatcccgaggccccaaggagcggtgggtggcccagctgccttctcccctcctcctcacccccagcgccccaccaccttgggaaggagctggcctgccttaaaagtctgcctcccagggcccctccagtgcagacgccgagaagtctagatgctggggtgttaggggtgggatggggagaggtgaaattccagactttcatgcagaagtcatttacctgtaaagcacatttacaaataccacccccgccatgcgttctttttccatattatattttcccctctgcaactcaagtctttttcagctctttttttttccacttgctgagcctttttcctgccaccctgttggcctccaggcgagagcccctgggactggagcatcccaggcaggtcgtgcactctggctctggcaagaggggcccagcctaggcctcctgggagctgcacgctgagcagcagactaggaggctcagacgggatccagctgctcagccctgcccacggtccctaaatcaccgttgaagtgccccatccccctggatctcagcaactcctggaacagcagctacagccgctgcagcggtgcctgtggcggtgcctgctccatccccttcccagaggaaagcaacctgtctgctgactgttgccttgccagctgctgagactccagtgcaggagactgggaatcagaatgtcctgattcaccagacctggccacaggaggctgcttcatcaaatggaacgtttcatcattccaacccttttggtccagaaaatcagcacccgcaccggcttaaatcagcctgggtccaaactgagtcagccaagtgcgtgccttgagaaaggacggggtgagggcatctgagtgggggtggaggtggtgcttcctgactttataattcctcaggcttgtccttgcacttcccatggcagcctccagggggagtctgtgccacagccaaggctctccccactgcgctaggcttttgaccttagccccctccccgggaagtatcattgcttggggtcctgtggccttggtgatgaccggaggggctgcactgaagcctacaccttcctcacatgaccaggtgcaggggccagggagcattttgagaatggggcttccttaagcccattccccctcccatgggcacagagcattctcttttacctcaaagtttagaagtgaaggtcagggagggtgagtgacgcgtccagtgactaaaacccaggtccttggactcctcgtcagtactccttcctttgctccagagttggaagagccagcatggatgtgtggctttgtggccttgaccaagccctccacatctctgacggcaccgctgtgcccgtctcatgacatgacagatgataaggcatggctggctctgcgccggggcctcctgaacatgtcatgcccctactaccctctcagcatctgtttctgctgccccatctggctcagggctgcagtctggccgcagagagggaagctctctaaggaaggagaatgggctgggagaagccacctgctgccccttgtttagcaggctgcattccctagcaagccagctctgactatctcagtgtcgcccttctcctggtcacccagaccgccctgttcctggggcagctcatgacactgcgaggggtttgtgaagggtctttcgtgggagggcccttactcagagctcacaggcatttgctcgaaagacagcaaaagaggacctaagacatggggacttttctttgagtctttttcctgacactaggtccagtggaggctctttgcccaaatggaacatttacagtgagaaatggacaggagcctcgacacccccaccctatgcagaatttgacctccacccctattttaccaaggcaagccctccagcaaatgaagctgtcagacaggcttggggggggggcggggtcacagcctgggagggaactgcctccctctcaccccttggtgctggtgctggtggtccccaggttgagttggaccagaatggaggggtggagggactcccctccaggggactcccctcccctccagggactcccctccagagtccctcccctccagggactcccctccaggggagctacctgggctggctgggctctggggcttgggcagcctggagccttgggtttgtaaagcccaactctggctcttgtaggaggactggggggaaaggtgtagcagctggggtcacccttgcacatgtgtttttccatggtttggtcattgccacccttatcgagtggtagggaacccagacaccatgaggggagaaaggatttgcccagggcagcaaagctgggatgagtctccttcccagagaccagccatcttctctgagggttccagcaggcatgagccccagcaggtatctaagctgagggatcagcactgcctgggtccgcccatctctaggagcaagttcttgggagacaagggagttatcccttcaccacttacctcatgaccagatgggagtacttatgtttctgctggagtgatgggggcaggcctatgtgctggtccccagctatattctgggcctctgcctccattaaagctccttgtcccagagccacgtgaaagtgcttgcagacagagctttcctgaaacacagccagaggtttcctaaaacatagcaatcagcctctgcagtgggcagcccaagtcttgatggcttcatccacttgtacttgacagatccatatttggtccctgtacttgactgcaggggcagcactctgggctgtgtcccccttcttgccctgtccagctgtttctttatgctgactcctgacccaccccaaaggggtccacacagatctgagctgtgagtgatccctgtgagcctagctgaggttggcacacgtggggtggcagagctgggtgtctgctcagctcctggatgcaaagcatcccaattcacctttgggaaagaagcccttctgcttgcacctctgcctgtggcacacctgctcctgcttgtgcatggcgcccagtgcccagcacacatgcactgagacaagccctgacacctgtgccctctggctgcatctcatccatgagcagcgatattcagtgctccgggaaggcaaggctgaaggcgttttgctcccttgccctcccagtttgcttaggaggccctgcctggcgtcctacttcccttctgcacagtttgggagccatcctaatcccctgcgagccagcttctctgggaggtgccgccctcggggagtcaggcagcggggaagttctacaaaactttctctgagttagtcctctcatcttggaggctgagcacgtcctgtggtgtgagagggagtcttttctcctgccgctcccgtctgtgtccatctcctcacgctccagcacctgcgtcattgcctgctgccgcccccgctcctccagcgcacgggaatctgcatgcatcagccccctgcgtcagctcccctctcactccactcgctgatgacaccaggcttgctgtggtcgggataacaggctctgttcagccacctcattggctcctcgctcctatctatccaatcagggccaggggccccttccttcgaggttgctgggcaaccttcagaggccacagaggcagggagaaaggtagagcaggaacatgcccatgggcatttggaggccatctgaattcagggaaggcctgtcctcatctcccccgcccagccctgccagggacacttcctcagattgccatctctcagcccacttggccagagacaggaagagggagaaagaaggggatgaagggcgggccggggcatctgcctggtgtctgaggtggcctggcctgtgcaagaggagttggacttggccctgaactgccctgggacaggctggtgttgcctgagtacggggctttgctcagagtcagcacagagaggggtactgtggagtgtggccacatcttgtggggcttcgggggtgcaccacgagggacagttcatgcagagggtgtcagaaaagccaaccattcctttggtggcccaggccaggtcctaagcaggatgatatggagatttccaaaaaaccagaagtcttctccaaatcaaggtagaaatgagggccatggtactgaaaaggcctagagtggctgtcctgaccagaaatgtgcccacacaggccatcaagacacccgtgtcatggcatgagagatccagagaggcacatgttctagcttggtgtatcctgtcaggaagagacccagtgagcaggcccacagatgccaccttacagatgaggagacctagactcggagagtgggatgtcacagccatgtgaggccacttagggaagaggagcagagatgtaagcacaggccacagcccatggggacagtgtttgcttttgggttgtgtggcctctctgggtgtcagggctaatggactttgaaagaagcctgagttcgcagaggaagaggaagactggaagacttgggcaggtagcaagcccctggcaccactttcaaaggtggctaaggaaggaacatttgctctccatcttcttggcagggtaaatgggaaggtgcagggaaccccagttacagcagtttctttttcttcaggaactttttctgagtctttctcaggcacaagcccagaggcatgagagagcttgacatactggactcagatggagagtgagagtgtagggctgcgggagtgggtggcctgctccgtggggtcctggagtcacatgtggcaggcctctgtggctgcatcaggccgagcagcacaggcaggcacggtgcagctgggtgagtctgaagtgtctcctccctccagcgggtgagcattgctgctggggcccagcggtttggaggaagccatagaggcgactggcagtgggtgtgccccaggagcactcgaggccgtcgtgcatgggcttacctgggccactgcgtggctgggactcagagccctgggagtgtggccagggccagacacgggcccactcctggctgactctgctgaaggggaagcaggagcattggcacagctcttgtgcgtgggctgcacacggtactgctggccttctgagacctgatcccaggagtgtgcatgcagggtgcccgcctgacacaggggtggtgctccagcaagggaagccagtgttgttattgcttcccagaggacggcatggttctcatcgcagagcggagcccaggccactgtcccagtggttgggtcttctggccgctttgctgggacctgggtgcagccctggggagggctggagtcctgcacacaggctctggaggcttcactggcttcccaaatggggttcacatccgctaatgactgccccggagagcggagagctgagggtggccctggggcagcagccatggtggccagagggtttatctgccaggcctctgtggtgggtgctctctccctgggtagactgggcctttccccccaccccctgctgccacccatatgaaagcagacataggcatcgcatgtccacacctgagccataaccggtccctgtaccaggctcttcagatattctggacgtgagcctcgtgagcagggagttgtccttgccccctggagtactttgctttctgtggaggtccctctggctgacttgccatgggctggggagccagggcgggattgcgtggggtgggagaggagccatcagtgggcctcatgtgccctcctgtcccgtcatctcttccctgggccccgtacatgtgtgaacggagaagccggcctcctgcttccaggggtgccaccgccactgccactgccgctgcagcaacctctgtttggcatccggcccgaaacacccctgcctgctctccgcttccttctccaccccagcttgtgggaaaagacgaaggaggccccgggaagaggcccaggctgcagcactgcgtggcccaaagcagtgcacagcacagctgggccccagaggctgagggcctgcccttgctgctgtggggatttcctcctcggagtgagcaagcaagagaagtccctgcatctgttcattctcctcacctcccatccttcctaggcactgcttgcctggcatcaactctttttttttttttttttttttgagatggagtctcactctgctgcccaggctggagtgtagtgatgcgatctcagctcactgcaacctccgcctcccaggttcaagcaattttcctacctcagcctcccaagtagctggtattacaggcacatgccaccatgcctggttaatttttgtatttttagtagagatggagtttccccatgtcggctaggctggtcttgaactcctgacctcaggtgatccacccaccttggcctcccacaatgctgggattacaggcatgagccaccacgtccggccctggtatcaactcttgagactaatcccttggctgctcaagcatactccactcgcacttcatttgggtaaaccaccgtcgggctcatctttagcacacagaagatacacgttcatgacaggaaaattagaaatacacaaaggagcaaaatattttggtgtatatctttacagattttttcccctgtgcatttttatgtaaatatattttgacttagatgacaccatcatacacatcctgctttacgggctgcttttcactgagtgatgtatagaaactgtacacaatacaggtttataaagcatgttaaatactacatgtctcagtatgatttgtaatagctgcatagtatttgcttgaatggatagattacaatatgtttaaatatgattgatgggcatgtagattattgccacattttcacccccatactcaacactgtgatgacacctgtttcatatacatctttgctgtactcgtgcaatttcttcctcaggctacttggctgcgaggggaattactggaccagcaggcctgcccttaagccttttgatacatacagaaactcattctgtcgagattcctggtttcccttcccacaagagccaccaggaagccacctctggaggggtccacattccatccttcaaggctgcttacatccgtagcaagggtcttcctggctgtcactgagtggagggccactctgccctgctctctgtgaagggctggacaaggggaggggacggtggatctgggaggagacctgggtccgagcaggggtaggtggcttcaggcaatcactccctggtggggtgtgctgggctgtcacagggtgcctgggcttggtccttgctgaggttgggggaggagcagggcttgcctgggaagacttggatctgcaggtctgtgcctggctgtgggagttaggggaggggagcacccagtaggagcagggctggcctcgacgtgccgggccctgagggagaagcagggcttagctcggcggaagttggaagggcatttcaggtgggcggaccagtataagctaaggcacaggcattcacttggcagggctaccttccagggactccaaggcacatggtctgcttggagcacagtgtcggcattggggggaaagaggctggctcaggggactggtgattttgctcccagtcttagaaacagtgtggaaccatcaggtgctgactgagaattgaaggctgatgtgggccaagtgggattagagaccaatgagtgttgcctggaggaggtgcagataaaggcagcaggccagggaccagggaggaggtctcaagggatcgtggcctagaccagggcaaattggagggagaagtcagctctgtagatgggatgtacattccaacctcatttgcccaccccacccaccccaccccgccccatcccatcccatcccatcccatcccatcccatcccatccctcccatcccaccccactacatctcatcccatcccatccatcccatcccatcccatcccatcccatcccatcacatccatcccatcccatcccatcccatccatctcatcccatcccatcccatcccatccatcccatcccattccatccatccatcccatcccatccatcccatcccatcccattccatccatccatcccatccatcccatcccatcccattcatcccatcccatcccatccatcccatctgatccgtccatcccatcccatccatcccatcccatccatcccatctatcccatctgatccgtctatcccatcccatccatcccatccatcccacccatcccatcccaccccatcccactgcctgacactcatcactttaaaggctccttgtcccaaagaactgccttacacttcatcgtgtggaaagactctactttggcagagatttttctgactctttcatatttattgtctcatcaaaaaagaaatttcacttgtgagactcagccaggcgtgagggaaaggagcccatgcagaagcaccagccctggtctttgtctggcaataaacccggagtcttctgactggagtctcagctataaagacgggactgaaggcagcatggtgccctctgcaggggacggatggtgttcccacccagccctgccctcctttgccatgggtccctctgcctctgtcattctgcatgtgcaaaagtgtctgtcttgactttggaagtggcttatttggtcctgatttggcaggaaacttctaggcaatgtggccatcaggtttgacaaggggtaactgatgagtccttgtgcctggtactgggcctgggatggagtccacccccgaaactgtggatgaccgtcacctgcttgccacgctcatatgtggaagctggtggctacagtccctgaggccttagaaaggagtacgtctttgaggtgcccagcgcaaaataagtcatactagctagtacagcctagcaaggttagaaggaacctaaagacgaaagactaggaggtcctcctgcaggtgaaaagctgaggcccagatgaagtgaggaactgtcccaaggtctgtagtcagtcagtggcacccagagactctgcacatgtgccctgcccatggggccactccacaggttgctgggatggggacagttaggcctgtatggccctaggaacacctgtggagtgagcgccactcaacagaactctaacgtggcagctttggtgcagggctgggcacgcggggctcccatttgcagtgatgaggtgccattcctggcacacagcaggctcgggctgtctgggctgctcgttcagtgcagtttatggaagagccagctcttgctgatgtggcaaatttggtttgctctcgtccccctgccctgcccatttgagtgtgcccctgacctccacagaaacacatccaggccctgccagctggcagcagtgctgagctggtcagaccctagccctggaggggcccaggggatgaaaggccctggagagaaaggctcttctgctttgtgactatgccagcacaaccagggccctgcttcctgtcatgcccacaagcctgagcccccagcccctattttgaggcccaagggttcggctgtggccactcagggctccctgcagctctgggtcgctcccagcctggagagccagcttcatcaccctgggcccttctccggagcaaatggccctcgagaccaccacagctcacccctcatgggcacgagagggcagcactgggctcaagggcagagaggctgaaggcagtgtggcaccgtctgggcagcatgagcagcaccgggctcaggggtagagcagggcgagaagacacagaggaagaggaagcagagctcaaggcagctgtgggccagggcgtaaggaagcctaacttaccacattgccacactcgcctgttccctgagggccactaggatttggcagtggggccctgggctttccccactgaaggtggagccaacccccgaaggaaacagggctgcacaccccagaccattcttggcgctgtttgaggaccaccgcgcctctcctagcagatgacttgagagctactgctgcttggctccttttcaggtggtgccgggtacttataggagcatcggcgcattccatcctcacagcagtcctgaaaggtagaattttttttttaactatcattttacaaatgatgaaactgaggcagctcggagaggttagctgacctgcccaaggtctgtcagaaaactcctaaggggtgagaagcaaggtccaaccccaaagcagctggtcccccagcccgtccctctccacaggccatctgcctgccctgaagctgttcggctttggatgcactctctcccaccctctgagtccaccagtgccagctgtcttccccacaccccccagcctgagccaggctgttagcactctgtaggagggctcatgttctcccgttatcagtgatcgctttgaacagacagtccctggcagcccctgagctccacattctctaggtgagcagccctgggcaggcaggtgggtgtgccgctgggcagcagcaggtacagtgagtgctggccccctggcttctgcccatacttagcactccaccaacgcttgccacccccgatgtgcagagggcagtctggatgatcttggtgtaccaggacccatatggtcacctgcaagacactacaaatgcatgaagtgacagcatttgcttacctttatccccagaagccctgctgaatcaagtgagaggagagctgcggagcaatcaccatgagtatctcagctcttggaggccgcaccaaaggtgaggcctgggctccctggtttcccaggctctgtttggggctgtttgcttccaagcctgcccctacaggccacaagcactgtcccagcagcaaagggagagcagcatactgggagaactggaaaggaggtcgagggtcctggggctgcattcctcttctgaggcggttggcttttcccaccacagggaagcctctgccaccaggcgaggaggagcgcaataacgttctcaagcagatgaaagtgcgaaccacgctgaagggggacaagagctggattaccaagcaggatgaatcggagggtcgcaccatgtaaggcaaggaggcggggagggaccgcagcaacgtgggggcgcgcaatccgtgggggaccgaccatacctggggatgcgaaggggcttccaccattcagagctccgccaggccatgtggagggcagagcgtgggaaaggctatccagcaatgtcacagggtgggagagcccctgggtgcctgggaaggagaatgtgtggcagaaatggcaggacttgctgggcagcctctaggatggaggccacaggatggcaggtgacagggagtctcggagccaatccttcaggatgcctctttcccccagagagctgccctcaggccggagtcgcgccacatccttttcatcagctggggaggttccgaagcctaggtaagaggtggtgctcaggtggctggtgggtcagccccagggactctcctgcagcttggggccagccctcaacagggaggggtgggcagtccacaggggacagggatgcagccccagccaagggtctgcaatgagtaatttgaaatctgcaggaaggaggggcttctccactgcaccttccttttgggaaggggagtgtaggagtcacttggtccaggcccttggcctggctgtgtggctgtggggcagctgacttccctgctgggcctccgtggctccagctgttaactgggattgaaattgtctttaagaagaagacgacctcccacccattccctgcagggagtgatactgcctctgagatgctttgggcagcttccagagtcacagtgactcactcctgcaggtcaccctgactgcttgagtgtacttgggactcagcatgcctgtagagaggcacgagtttgctctgactgtctcccaagtttaccgtgacatattttgtcagctgaccaaggagaactggcttctctctcttttgggggcttttccataacagtgtctaggggggctctgaagcgtgggcacaccctgctggcctctggaggaactgctcctgacagagaaagggaactgaaattcaggctcgctccttgctccaaacagccggcaggcggcttctcagggggtggtagaggcagtggcggcctctggaagggagggcctcaagtttacagccagcacacagggctacctttagtaactacggtctctctgtcacccctcgatgactcagcgcccactacctgccaggtcccatgctgggcacagaggatgcaggagtggtcaagacaaaggccctgtctttgggcaactgacgtcccagcaggggactcaggcaggaccctagtaaacagttcaatacaaaagcgagaacccccaagtgtgcctgcaacatggccacctctgggaggctgtcccctgttagagatggagattgtggggttggagactaccggaggctctgtgttgcccttgacccaaaccccgatgctccagcccacatcccctccactgcaggacagaagggtctaccctgaccccttgactcctcccctaactctgaggaggactctttgcaggggcccctaactcctgcccggaggccagaacttccaggctgaccacccctggctgtcagctccctgcccgctcgtcttggctgccccctgagttatctgagccccctcagttgctgccaagcaggaggtcccaagcacccagagcctaatgtttcccagccgctgaacaaggcctggccgcgccctctcgtctcaaacttccaccaagacttggggtgtgggcatgcaaggagctggagcaaagagggccccgagggacaggaagggggacagctggcttcggctggctgctgcctgggctctccccttcaagccctcatgcaccttcctggtggaggctgttgagggagatcaggtcagaccccgggctgaggggaagcctctggctctgactggggagcctccagcttgcactggttcagccccaagcacagaggatgggagggctgtcagctgagagcagtgctccgtcggcgcagcactgggaactggctggccaaggagaagctggactttggagaggccatcaagctgccttcctaggcacctgccatgaggagtcacctggggcacttttcctgggggagcatgagggaaataggcagagcatagcgggcacctgatcaggggcacagggggctggcacccctcgtttctgctgtactgggacacctggagcacttgccagccaatcttatttgctatcgttaagggcaggataaagtaggatgacctcagccctccagcaagcctcgcttcactccaccccttcttctcttcggcaggcctccgagcacaagggctcccactggctacatcatccggtaagtgaccgcaggactctgccggccttcctgtgcccactcacgccaagccctgacttcttacccctccagtccctccagggagctcaccggcatctcctgggctctctttcaggggagtgttcaccaagcccatagacagctcttcccagccccagcagcagttccccaaggccaacgggactccaaaaaggtatgtccatggggtgttggccagtcggccagtggggaggtgtgagggcctggtctgggctcctggcagagacagtgctctgcctatcaggactgtggggccttggaggtgccagctttcatcctgggtagggcaggaccctggagagcagggtggggtgaccagaggagatgggctggggtgggactggcagtcccaagtggatgtgtgggtctctgggaggtcctgggccactaacagtgtccttgtcctggggtcagtcctgactaggcctggctaatgggacagagaggtgcaggagtttgggaggggctgggtgtagagtccccctagcctggcagtgggcacccttgacttgacttgctgatggcattgagaaggctgaagttgcatgcaattcaagcaccttggcatcaggcattgcctgggactccgtcagactggaaaggccaaggggacccggaaacaggaagcaaagacacaggcaagagcccgctgggctgttccctgaagctcggtggggtttgcctacacagctgctctgagtggcgcagttccgggtgtctgtcagggccaaaagcaaagaggaaaggctcccaggcagctcctggtccacctctcatgtgtccactgggctgtgtggccaaatctggaggcaggagggagcctgcaggtagacacatggaaccttctcctctctagtgctgccagtctggtgagaacagctaacgctggtcctccccgcccctcctcctctggctacaagatgaccactgaggattacaagaagctgtgagtatgcaacgccaggctcagcgtggttccctcctccaaggaacaagtccaaactctgggtccactgaaggcagctgactacttgccaccgagcacagcccgggaagtcccgcctgcctgacactccctgccagttgcagctgtggcctggagcccaccagagggtaacaagccccagaaaactggatggctgtgcacattgcacgtctgatccgaggcagagcggagaccgcaggaagcttgtaggaggggccccacggatctggggaaagggtcatgggtcgtgaggctgctgctggctggctgtgcttcctgggcttggccctgcacccggccgagcctcaggtgctctgcctggctgcactgggctgggggcctggggatcctcagggtgctgctgtcagtctgagcattgtgtgcctaaatctgagctgcttcttggatagaaaccttcgggttttcccttagtgctccccttggggtccctttcaaagccccccaccccccactgcatgctcagggaggagggttctctggacagaggtgtgaattgtgtctctagttcccaggggaccacatctttccgttgtttgtcccttgcctccatcatccagggttggggagctgctgggtaacctttctggggaaggggagaggctcgaacagggagggaggggagagctggtctcagggaggaacaagtggcatgacctaaggcccaaaggcagagatattgacttgcctcgtcattgttgttgaaagccaggaagccaagctgctgagggtggcagcctatgacaggaaagcgcctctcccctctcttagggcaccctacaatatcaggcgcagctctacatcaggggacaccgaggaggaggaggaggaggaggtggtgccattctcctcagatgaacagaaacggaggtaatggaatggtgccttttgggcatcccggggggcagggcaggagcctgagtcttcgaagactgctggaatgaattgtactggttggggtgacaaaatgcacaacacgtaggccatcagcggtagcccacggagcatgagaataggtgtcattctctgagtgccagaaccacccactcagtgttggaccagctgaggggcccttgagaaccttctgtggggtagaacctaggtaatgtgggtccggggaaaagcctcctcatgtggaggctcttcagggctctaaatcggtttgttagaaagggccctgagacagttgaacaaaaatattcagggagaagccacctgcacagtgccctctatctgcatgatctgcatgccttgggggttctgaatgccccggaccccaaactgagctccaggcatgcacagcagtgggagtgtgccccatgctgctgaaattctaccctagtctctgcgccaagctgccctcgtccacacaggccagcaaagttccatggacccttgcccctcctcagtcctctgtccatggggactgaccacataccacccagtgctggtgaactatgacaggaagggtttgttaagcaccttttgtatgcctttggcttggggcctgtacagcagttgggccctgaggaaataaagccctcccctccctgggctcagccagccaccaggtccatatctgctgacccatctgtggcgcaggaatcacagcaaagccccattgccaaaggccctggcagattggctatcctcagggaacagttcacagtggcaggggcccccaggcctgggtggagcaaggaaaagagccagaagctaggagctgcctagcattgaatgccagctctgccacctgctaggtgagtgctcttgggcaaataatgaaagcttcttggactcagtttcctcatctgtaaatcacagaggatactagcgtctactttcctggattgagaagagcaataagccaatgcgaggatgttggcatctggcgcagagccgggcacatgccacatgctccataaacatgggctgcccttccttcaggttctacatttcctttgaatagtccttggagcaggtgcaaatctggtttctctcaccccttgcctccctggggtggccctaagtcaccccgagtccatcccaggctaggctggcagagcatgtccagcttggcacccatcagatgctcccccatcccgtgtcaccccaggtcagaggctgcaagcggtgttctgaggaggacagctccccgggagcactcctacgtcctgtcagcggccaagaagagcactgggtgagttgccaccaactggctccaggctctaggacagctctcctctcctcagagctccagccttctctggctgatgaaagggtgggtggagagatcacccccaagggccttcctagctgagccttctcagattctcagatgtactttctagaaaatggagaggtctggcggctaccaccagggacagtgaagtgccgggaatggagagggcccaggaccctctgaggtagagcggtcttgatgtcacctgcccacgggctctgcccaaagcattgcctttctgcttcctttccagcagtcctacccaggagacacaggcaccgtttatcgcgaagaggtaagtgtcatcaagggacaccttggaggcctgttactggccacaggaaggccttccgtcagcaggggtgtagtgtgggagctgtggagaggggatgtggatgtgggggactactgtccctgagcagggggagttgtgaggggctgggggcttctgtctggaggcctggcaagcacctgggtggctgtggtagcatatgtggtcaagctcttccatttgccaatggctaatggggctgggcccctgacccaacgtggagcatttccaaggccctctgggagttgttcccctgcccctgttgcttgcctgatgccttgccttctgctctcatccaggatcaaaacctgggccatcaggagaacttcccctgggaggtgactgtgacattggagatgggccctaaagggtgaacagggcttaacagggaatgatcagaacgtcgggatactccagctgaatgagggaggggtgtcaccattagttgagacagggcaccttctggaggaggaaaatattcgggggaaagcaagaaagaaacttctggaaacttgaatttgagggacttccagttgagtggacagggaaggcctctctctgtgctgaggtggctagctggggactgcaaacccaagagaagacagcatgccaactgccccaggcagagggccccagtgcacaggcccggggtgggactagcttgctgtgttggaagaccaggaagttggcaggaatacagagagcagggatggtggcagcacaaaggaagtgacagagaacggggggcggtgggggggtcttcctggctgcatttggttcctgtggtttctgtaacgcagtaccaaaaactgagtggcttaaaacatcagaaagggattctctcccggttctggagaccagaagtctagatcaaggtgttagcagggtgggttccttctggaggctttgagggagaaaccatcccaggccactctcctggcttctgctggtggttggtgatccttggtgttcctcggcttgtacctgcatcactccagtctgtgcgtctgtcttcacatggccttctcttctctgtgtgtctgtgtccagatttccctcttcttacaaggacagcggtcattggatttaggacccatcctactccagtatgacctcatcttacctgattacatctgcaaagaccctatttccaaataaggttacagtcacaggttccaggggacatgaattttggggggacactattcaacccagtatgctgtccttatcctgagctggagtcactgaacccccagcctgggccacctcttggccgtgatcctgaagggttgggtcagttagacgccactggaagcatgttctttgaggcctccaagctctagggcagccaagaagaccacgagcgctgtttctcttcttgctcaaagggtggaggtggtggaagaggacgggccttctgagaagagccaggacccacctgctctggcaagatccactcctggctcaaacaggtaatccattgcgctcatctctgcctggggctggtggctgccatacctgccactcagtcactgaggaacctcagtcagggcacctccatgctgggcttcgagatcagtgtccccatgtgcccagtgacaagacgggacaaagaaatcagtaagagcccatctggctggatgtcccagggctgaaaggagcaaaacagtccagccccccgggagagagcacctggctctggtctgatgagtacgtatctgtgtcaccttaacccttgcaccactgagcctggtggcaacttgaacaccccaagaaaaagtaccatccttggggtttgagagggccagccaccatggcagtagcatgccattgtcagacttgctccttgcactccaataagttagccacattcagcatgcccagggaggaggctctgacatctccagagcctctcacagccaccttctttgccagtgcggatggaggcaggaccaaagcgtctcgggcaatttggatcgagtgcctgccaagtatgcctagccccgctgggagccaggagctcaggtgggtgccgagagctgactctggcttgtgagtgggtgtgatggcttcccgccagcctggctggctggttctgccagctggggagggtctggcagtggggtgatggggcaaggacaggctgagcactggtgatctcactccaggaagggccgtgatttgtcttgatttctgatccctgagaatctgggcagataatggtgctctcttgtctgtggacaactaataccttcttgtactttgtgcagaatggtgctaagtcctgcagggagagccaccacctgctgttgctgctgtttaaagtgcctgcctggattgagacctttgctcaaatctaggtctcctaagagctgcatctctgtagcacccttggaagacccctgcatccagaaggggagagggcctgtccctaccggtcacttcccaggcccccaagggctgttcaggctctcctaataccatagcaatcccccaatttgagctccacagccatttatagacaggtgaccactgtcctcagggttacttcctcagtctgggagggagacagaaatgctggcagagggagccaggagcatgaggccagctccctccatggccccaggcagcagactgccagggtgcttctccttttcactctctccctctcttgatcttctctggttgtctgactctccccataagaactttggtccatagaagatgtggaaaggaagatttgagaattctttacaaggcaatatctagggcagagctccccagtctttttggcaccagggattggtttcgtgaaagacactttttccacgggacggagcaggggatggtttcaggatgaaactgttccaccttagatcatcaagcaccggattctcataaggagcgcacaatctagatctctcacatgtgcagttcacaatacggttcgcgctctcatgagaatctgctgatctgacaggaggcggagctaaggcagtaatgatctctagcttacctcctactgtgcagcctgattcccagcagaccacagactggtactgatcctcaggctggggttggggacccctgatctaggggacttggcaattgagggatatgggggcaaaggctgccacaacaaagtattgtaccacaccctggggcgcttaaaccacagaaacgtatcatctcccacttctggaggctagaagtgtgagatcaaggtgacggcaaggttggttcctcttgagtctctctccttggctggtagactccatcttctccctgggcccttatatgctcatccctgtctgtgtgtgcctgcgtcctaatcacttctgtttttttgagacagagtctcactccgtcgcccaggctggagtgcagtggcacagtcaccactcactgcagcctcgaccttccaggctcaagagagcctccagccttagcctcctgagtagctggggctacagtcacaggccaccatacccagctagttttttttttttaaatttttgtagagacagggtttcaccatgttgcccaggctggtctggaactctaggactcaaatgatcctcctgccttagcctcccaaagtgctgggattgcaggcatgagccaccgcgcccagaccctaatcacttcttataaggacattggtccaactggattagggcccaccctaacaactgtattttaacttagtcacttctttaaaggccccatctccaaatgcagtaacattctgaggtcatgggggagttaagacctcaacatatgaattttgggtggcacaagtcagcccataacagtatacagttctcatttctccttatttctcttttaaagaaaggcaataaatggtttcaggtgcctttctgtttgttcgtttgtttgttttgtttgtttttgagatggagtctcgctctgtcgcccaggctctgtcgagtacagtggtgtgatctcggctcaccgcagcctccgcctcccgggttcaagcgattcttctgcctcagcctcccgagtagctgggattacaggtgcacgcgaccacgcccggctaatttttgtatttttagtagagacgggtttcaccatattggccaggctggtctcaaactgctgaccttgtgatctgcccacctcaggctcccaaagtgctgggattacaggcgtgagccaccgcgcttggcctcaggtgccttttagaagataatataggaggctgggcatggtggctcatgcccgtaatcccagcactttgggaggccaaggcaggaggatggcttgaagccaggagtttgagaccaacctaggtaacatagcaagaccccatctctacaaaaaaataaaaaataaaaattaaaaattagttgggagcattgatgtacacctgtagtcccagctacttgggaggctgaggtgggaggactgcctgagcccaggagtttgaggctgcaatgagctgtgaccgcacccttacactctagcctgggtgacagagcaagaccctgtctctaaaacaagaaaaaaaagagagaaagaatggaggagaattagattgtgctgtattatagatttaaaaggcactttgacatttattccacaaaattcctttcgatgtttaatccccatcatatggttgtcattgcaaggtggctttttaagtttgctcaggttgccataacaaataaaggctagagattcagggtccggggcaagctcccaacaggaggctcagcttgatgcttctgatagttctttcctccaattctggtcactcaatatttggagctcacccaggcagcttccaggaaagctgctggctgatcctgaccctggagggccgtcttctctgaccctaccacgttaggtgctgcactggaccaagcagccaccatcagtactcccaggcccagctcctatctgcctggtgtctgagaagcccagcccgtgaggaacaatgactcaatcaaactcagggtcctgcagcacttcagaaaaggctggtttgtggcagagtggaagaggagaatgtcacagccttgtccccaggcacagacctatcgaggctaccctctccccaccccctgccctgccctgtttcccttagctacagtgcaaaggtcagctcctcataactcttgccccccttgcaacctgaacccagtttagggaccctctcttggagaaactggttctacacatgcaccccttctcggcccccaggcctggctgctttacccgaagcactggtcaagcttgcctcacctgaccagggcatggcctcctgggtcccggtcctaggctctgcccagcatgctgcctggcagagcgtctggggagcagggagtaggagcacagcttctggcacaggacaaaaccctggctttgcatcagactgactgtgtgaccttgagcaagtctcttcatctctccatgcatcagtttccccgtggataaaatagggagagcagtaatagctacttcccaaggctgtcccaaatgctaaatgagatcgtgcacctgaagtacttaccacagtgcctgggtgctggtatcctcgggggctcccagtcataggcgtgctgagctgcagggcccttattcaaatacaggaagagatcaatatctccacctgctggcatttgagggaaatgtggccaaaggcagtgaaaaggaggtatcccctcgccccacatccccgcctcctcgctctttggcagaatgagtcacacactgtttggcacaggccacagttggtcgcattcccacaggtggctgtgatcagttttgggcttcaggcttcagcagatgcctgcctctcttccttgggtgccttccaagggtgtgcagccttccagcgtggtcctggacttcagcttggactggagctgtctgtggttgagagtctggggagatggtagggtagcgggttgtgggggaggagagacccttgtattagtttactggagctgctgtaacaaggtaccagaaactgagtggcttaaaaccacacgcatttatcctctcacaattctggaggctggaagtctgagatcaaggtgtcggaagggccatgctccctccaaaggctctgggggaaaatctgttccatacctttctcttaccttttgttgcctgcaatccttggtgtttcctggcttgcgcccgcctcactcccatctcggcctctgtcttcgcgcagccgtcttccctctgtgtctgcccacattgccctagtctgacatcagtcactggagcaggctggggtgacactttgttcccatttcctctgtgacagagccagaaacgccagtgagaaaatatgttgtgcttgcctgtgacatccctgttccctggcaccacctgatttaaatgaggcagccaggggttttatactgtcatcataaatgacatcatcctcaacaacgatgtcatcgtcgttatcacgagaggagatggggagaagtcagagctgtctgtgtgtctagggcccctcctggctttcatgatgggagaggccttgtccttggtagcccttccatttccctctggtcactttgagcactccaggccctggccagggtggaagtggagggacagagatgagcagcccgctgacccagccctccatggctcattccttgctttcaccttggccactccatcccctacccctcctgggacccctgagtggcctctttaaagtgccagtctgaacctataaaccccccacctccacttcaagcccatcctgcatcttccctttgccataccagatctagtctgtacattcaggacccctgccagcctctacctcctcctcctcccccgatctcccttcagctggcctgggtcgggctatgcctccatgaagcttgtccactgctcccatggctaaacctgttctgggccctgcagcacagcaaggtcagtttccatgcctctctgcccctgcctgaccctgctgggcccagagcttcaccagggcaggcctggggctcaggcttgtctgcacttccagggcccagggacaaaggcaggagtgactgcaatgtggcttggaattaggctttgctccatggacctaaggaggtctggtttggggtgaagggtccacccccagaaagcctgggagctctatattctctctggccctggccacaccatggccaagcctgctgggcgtcatgccttgcagtacggccagagaatgcatcagacttggagggatgtgtgtccggggtggcctgtggtcatctgggggagggctctgagcgtggctggcaagaggaaagctcaaaggggccctttgtcctcatccccgagtctgcgacatcccctcccactggttttcattccatatttggtctgtgggttttctcagtctctcgtacccctcagtccccaccagtccatgaatgcagaactacccctggcctcacaaatggccactttggataccctggtggggtcacaggctgcggttgcccctgcaaatggttggtagaagcacgggttgggaggtttcatttctacccagaagggcccttgctgtgcctgagggagggctgggctcaggtcaggggtgggagaccggggaaggggcctacaggtcagtggcccgagctcagctgcagcaccaacaaggctcaaggccaaggaggagatgagagcacatcaaaagggggcagtgggtctgggcggcccaccgcactcaccagcccaagaagggggagacttttctcacctgcaacccactgggtctctcctttggcccgcagctcaagaggtgaggaaattgtccgcctgcagatcctgacacccagggcaggactccgcctggtggccccagacgtggaaggcatgaggtatgggggtcctgctgctgtcctggctccctggacaccattctagagatggaagcagcagcctcaggtggcaaatgatgaggcctagggccggctctgccactgtagggccaacaggttgatgggaggcatggtcgacctgggttttctgccccatctcattctttcactcagaaaaccattatggagcaagcgcttagtctgtgtaagggcacaggcccgaccctgggacacagtagtgaacaggaccccctggctggaattgccatctgcctggtgggggaggcagacgccgacatgagcatgaatgaggtcagccagagatgctgtgtgccaggagcccctgggaagtgacagctcaaccctgccaattgctgaagatgggaccagtcagccgtgctggggatgttggtgggggtgggaggaggattgggtctaaggagcccgtgaaggccactgaggccattgccctgcctgtgtgagagggccactgggaatagagtggggtcactgggtcagagtccacagctctccatgccactaggctctgtgctggggaggggtgggtcaaggaggccacaaccagcagggagcacgaggggctcagcctctgccctggggtgggggtcagacagccaggtgacatgcaggcaggattcgggggctggggtggaggctaggagagatccgagcagggagactgggcccctaccttgtgaaggccagggactggggagagaagcgggagtgtacactgaaggtcatcccttaatccctggggtggcaggaacttcgagcagaggcctctcaacagtgtggtgggtgggagtgcttggggagggcttcctggaggaattgacatccaagatgagtcctgagcgatctctaggtccctttaccctcctccttggctcctcccactttaattctgcccccaaggcaccaagtcctgtccactttattttagagatgtttccatccctattgctctgcccctggcccaggcctccactgctactcacccagttgtctgcgaccgtttcctactgtcccatccctggactcccttccacatctacctgggtgatgtttccaaagggcagaagtagttatgccagccccctgcagaaagccctgcaaagcccctcccactatgctctgcagcctgaactcagtacctggccccacctgcaggctcctccctccctgggcctttctctgtgcaggctggaggctctgcctgagatgccctttcccctcttcatctttctgttccacctcaaatgtcctgtcttctgggtcatgtccttctcctgagtttcttccccaggcagcatctgagggcttgtcgattctgcatggcagcatccattctgcatggatgtagatacaatcactatgcccattttacagattaagaaactgagaccctgaatggttaagtaacttgctcaaggtcacatggtccagagcaggcagatccgctcagcctgccctactcccaccttccaccttctgcaccatagctcattgtactagttggggcagggagcagggggacagagaggggtgatggaaagacttggcatttgctgagtgaactcatttgacgagtttattcgtaggcattgaagtcaaaatttccaggagggaggtattttaaggtttgtgattgaggtttgagagagtgattagggctcaagagatttccacgttatatgcagacagaatagagctgaaatcatgagcgtaaactagctttacatggggctcatggtgagccaatggaagctgggcaccgacctcagtatgcaggtggcagccacctggccagccctcctggggacagctgggcgagggcagtctcttctcgccatgttgagagtgggcctcctgagggccagttgggagttagtgggtgtgcaggccagtataaaggagaggcaggaacaagtggagatccctgcttcaagggtggcagttgacaccttgggaggggaggagacagcccagcaagtggtggagcacgccaaagggaggagaaaaaggcggagaccaggaaggtgtgtggccagggaggtaggcaggtggtgttgacaggatcaagggaggaggggtggtgagaaggctggagtggcccactgggtcagcagtactgaatggtggtttgaaataatgatgggactgtctctcctggatttgacaacatggggctccctgaggacctgaaggagaacagaagggggcttaaattaggagattaggatcagggatatagtccagaactcaaatcccagctactcctcttattacctgtgaaatttggggcaaatcacaggggctttgtgtgcctccgtttgctcatctgaaagatgggcatgggtgataacagtgcccatatcctggggttgatttgcagagttaatgcatataaagtcacgagaacaggctcaaatgctcaatcaacagtagctattgccaggcacagtggctcacacctgtaatcccagcacagtagctataaaacaacaacaacaaaaaacaaaaaacagtagctattagtaatgaagttttgataattggccaatctgtcaatcagcagggtttgtttgtttttggttctgttttttaagacagcatcttgctgtgtgtgcccaggctcaagtgcagtggtgccatcacagctcgctgcagcctcaaccttccaggttcaacctcccaagtagctgggaccacaggcacacaccaccactcctgactaactttcaaaaatatttttgtggagatggagtctagctgtgtttctcaggctggtcttgaactcctggctcaagtgatcctcttgcctcggcctctcaaaatgctgggttataggcgtgagccactgcacccggcccagtagcaggttttaagctccgtggagacagctggcgtttgaggatgaggtaacagcccacacctgagtgtgaatggctgctgcatggttaacttccatttctttcctccataggtcttccccaggcaacaaagacaaggaggccccctgctccagagagctccagagggacttggctggtgaggaggctttcagggcccccaacacagatgctgcaaggtaactcagtgcaggaagcagacacttcattcccagaacacggagcccacatacacccagctgaaggacttccatggcctccggtgcaatgtcaatggatgcagctggggccaggaaggtcctgttcccactgttcccccagtacctggggtactgcaggtctttaatgaacatctgttgaaagaaagaaagaatgaatgaatgaggcctggagggaggtaggcccctgccatgattcctcagggagccagttagagagcaggaccaaactccagggcaggctatccccagctcctggcctgtgctgagttccttccattcccctgaagcttccacactcactgtgcttttactgcaggacaaagcagccctgccaatggccagggcaaagcaaggccaccaagctggcagtctgggagagtcagtgaccaaagtatgtgggcccccatagagcatgtagcggagactttcaggatgacccgtggactaagggagacattgtggcaaggggtgaggggtccaggacgggaagttggagccatagcggtggatgatgagtccagatgggatgattgtccccagtcgctgcacagccagcccactgacctgtcctccaagccagaccagtgccaaatgtgtctggtgagcagtggctgcaggctgggcatttcttcagtgagaacctggtagccagttacagctaagaacccacacacccgtcttctcagtgtggatccctggagcccctagctggaaccctgagccctggaaatgaggaaaggaatccctctatggcttattaccagacccacatgtcttgccccttgctctgttggcaatcagctccccccaccaccaacgaactaacctcctcctgactttccaccttgctcccaaccaacccatcaggtttggaaaaaatacagaaatacttcctgttagagtcaacttgggcttggctcagctctggtcagagcagcacagagtagcagccaaaggcctgtgcttctggtcttgaggcccactctcatggcatctgggttagatgagatcaaaacgcaactagagtcagcaaatactccacttctcataacaggtcaagtgcacagttgagtgatggcaatgtgggatccggagccacgggctcccggcctgaaggcttggctgcagtagacatcggctccgagagaggaaggtgagctgcccgggggaggcaggttctctcatgcccctggtgacagaccagggtcaagctgccaggctgcttgggctgctatgggtggggcactggtcacttcctatggctcctgtctactgcttctcccacactcccacattccaccacatcctgtgtccttgggctttccactttttggaatcttgttcatttttctgatccctgccactggccctcaagctcctccagagtaggcactaggcccactcacagctggaggcccagccctcacatggtgctggtcttgggctggtcaaatgaacgtgtagggaatacatgaagggacaaattaatgagtgaatgactgaatgatggaagagtcggcaccttcttacttcttggttaagctctgaggaccagctaggaggccctttgctcctgctttctcccttctctccttttcctgccccatccctaccccaggcagctctgctctgaggttcagggagaggaaaagcggtagccctggagagaccagcgtgtccagctgggctctggcttcttggacctggagggagtcaggggccactttctcaggtgatttgcagagtggcaaggtccctcttgtccctaagtggttccaaaccaagcctgaatcattcttggggcaaaggctaggtatgcagatgttggcataaatagtttagctccaaactatgctagagtccttctggttcagagcagatggctagggaggagtggcaaagccagtgtctgcaaagagctacaaccgcaagatatcatctgcctcctgcatcctactgcagtctggccaaggagggaatcctgtggggaaggccctgctgatgctttcctacttccctcagcacacccagggcccctttccctcactaacttcaatagtttgcaattcatgccatggaaccagagcccgaattctaaatccaggcccacaagtcaacacaggaaggggacagcaggtcctggcctctgaaaccactgtctccgagcaggtccaaggagaggccaccagagactctgttctttaagctgccactaatggggaggactccgctagagccctgtccatgcagcctgcatctttttgccatctgcagaggcattggagggatctttttaaaaataagctagatcacatttctcccctgctaaaaccttctagtggctctccattttccttagaatgaagtccaaaccctttcccatggcccactgggtcctgcatggcagaatctttggccttctatccagtcggggctcctgctactctccccacagtggtgcagcttgactggctctgctgatggctgtcgcggaagagacttctggtctactgtgattgggtggctctggtctcctccatgtcaccccgcctgcttatacaccctcataacatgaagcctgtgctgtccactgtttccttaaaatgaaaccaagcctcaaagttacttgtaaagtcatctgaagaatcttctagattttcatgaattttaacccagtcttttacagttgtcttacctatatagtagtccctaggtatctgtgggggattggttccagaacctcactcatataccaaaatccatgcatgttgaagtccctgatataaaatggtgtagcatttgcatgtaacctatgcacatcctcctgtaccctttaaagcatctctagattattataatacctcatacaatgtaagtggtatgtaaatagttgttatactgtattgtttagggaatgatgacagaaaaaagcctgtacatggtcagtacagatgcagccatcctattttaattatttttcccacatctcatctcatcctctcctctcctctcctctcctttttcagacaggaccttgctctgtcaccagggctggagtgcagtgctgtgatcacagctcacagcagcctcaacctctggggctcaagggatcctcccacatcagcctcccaagtagctgggactacaggcgtggaccaccacgcctggctaacttttgtatttttggtagagacgaggttttaccaggttgcccaggctggtttggaactcctgggctcaagcagtccaccgacctcagcctcccaaagtgctgggattacaggcatgagccactgtacctggtcccaaatattttcaatctgaagttggttgaatccacagatgtggaacccacaacatagagggctgaccacacttagtttgactataattttcaacaaactcctttattgtttttcctttttttttttttttgagacggactcttgctctgtcccccaggctggagtgcactggtgcgatctcggctcactgcaagctccgcctcctgagttcatgccattgtcctgcctcagcctcccaagtagctgggactacaggcgcccgccaccacgcccggctaattttttgtattttttagtagagacggggtttcaccgtgttagccaggatggtctcgatctcctgaactcgtgatccacccgcctcagcctcccaaagtgctgggattacaggcgtgagccatcgcgtcctgccttgtttttccaaaggaaaggttgtttctcatggcaacaaccactctccttttccattcattttcatggatttacttaatcatcgaacttagtgattcttctccattagtggcagctcaaagaactgagttgctgccccaggggcctttccttggatctgctcagagacattggtttcagaggccagggtctgctgtccccttcttgtgcaaatacaactggcataaagaggtctgggaccaaacaagagcacctcttagtgagtgtgctggttagtggagggcacaggcttgtataggcagtgattgttcagcatgccgtgagcatcagtctgcctggtttacagagacacagagaatgtgactccaccctgagaaggttgggtaagacattccccactaaatccatattgagtgggtgaatacaggtggactgggaaggtgcactgcttctataaacagccactgggccctgtggtaacaggaacacattagcacatgttatggcccaggcattattcaaagtacttggcatctatgaactcatttacttttctcagaatacttacgagacagacatgattagcatccctatttcattgatggtaaaactgaggcccagaaaaaaaggtcaggtaacatgcccaatgtcacacagctgggagatagcaaagccatgatttgcaacgccagagggcaaccactatgccacagagccccaggtgtcaggctgccttgagatataaatattgttcctcaagcatccatttgagcagcttcttggtcctcatcatctgtggggggcaggatccactttctcgggagagggtagacatacagacacaaagtcctgaacctggaccaggtctggccttctttcacaggctgtgtgcagctgctagctttgcctctttcctggaagaccaggatgggcacagtgccaactctcagtcctgcaagcctagaccagcagccatcaggtaaggttagggccactgccctagtgccctatcccattgccagacacagcctttggggcccagcctcagctgcagcaccccaggatccccctcgaacttctcagctccatgccactttcacatcaggtgatcacagcaagacagggaactccagggggagctctgaccaggggcagtggaagaagagggatgggtgatatgtctgctcacccagagagcccagcaccaacctacatggacccaagctgaggtggcagagaggagggcatctgaaggcagagcctgggaagagatcctgctaggaggtctcagagaacctctgctgtagggactacagccaggtttagcaagcaggagtcagggagaagattcccaggggcagccagcattagagggctcagttcccaggagcacaggaccggtggctgggatgggcaaaaatggctcctggggcacaaaggtacaatgggaagaagctgtgcattcccatgctgtaagcgtctgccctgtttcacccaccaatccaccagtgggcatggccactttgctgtgggtgtgtggagcatttggcaagtcctagtaaggaacgatctttcttaactcccataaaccctacagaggtgtaggtcaggtaaggatacgtcatgctcagggtcaggttccagccgcagctgagggctaaggggaatgggtggacgtggggcagggagctggaagaacactcgagagatagcaggtaaatgagacatggctttactcagcagcagctctcttacacagctttctcaaactagctttctcattagcagcttactctcacaccgtctgccctgtcttggctgcttagtccggtggcccctacgcacagctgcgtggccagctctcccttgccttcagggtcagcagcttaattctttctctccctgggcacgggcaagccaagctgtgtcctggctcccctctgtcctggctcccctctgtccacctgcaaagacagacagctcttgctctctctctttctctaggttcccgtgcacccgccatgtcaagctatgttgagctgagccaagccccaagagacatgtcccccatacacagcgtcaacagggcagttataccttttacagacaatagtggtttagagccaagtatgaacttacataaacaggttatataagaagtggaggtgtgcacctgtgcaccagactcattgagtcatgcaggcctggatatccccctctgcctattccttgaacaaagcacatccaggtaccttacaggatactagaacccaaaaccaggagacttccccagggaacccaagttggtcaggggcagtgtttgctcttgaactcaggtgctaaggccatgtccaaagctgacatgaggttgtcacacacagtggcatcggtgccacactaatgccaggactgagacaccagcctttactggaagacacagttcctccctttctggtgagaaggcagcctggagggggaagacctgggccccagccttctttggtctgagatctcagcaggcctgtgtttccttcctcagctccagtgccacttcagtctctgctgtccctgctgataggaagagcaacagcacagcagcccaggaggatgcaaaggcagacccaaaggggtaaggcatgagcagacagtgctgaacttctggggtggagagaggcagcttgggctgtgtgtccattggcctttggctgggaaggtgaggccagcaaggtttgtgagctggcctgaggcacatagcaagggcagaagccccaaccagaaccctctggcttctggggccagggagctttccactaaactgttgccttggccaggaaatacatcatagtcagaaagggtctttcagtcagcaaccactctgacagcaactgccttttgctggaggctggagcatgcagacaaatcagaaacacctctgccctccaggaactctcaggcagggggtgggcaaaggctggtccagattagagcaatacatgagcgctagagcaggggaagggggcttcatggggactgtatgtagctggatgtggtcagcgatgagtgtccttgttggggagtgctggaagaggaggctcagtgaactaggtagggcttgattggcctcttgtactgtgatattggagtccactgtgtgcacagccctctactcacagtgtctcatacggttctcctcacagtctctcaaaggtttatgcctaattacaacaaaacccaaaagcctggagcctaggtctctgtgcctcctgggaaggatagtgctccgaagaaaacagccgcagctgagatagagtgatggcagtgaggagggtactacttaggtgggtggaaaaggcaactcaggcgatctcctctaaagaggagaaggagccaactctagaaagaacacggtggagagagctatagataaggaaccacaaaccaactaaccctgaggtgggaacatgcttagcatgttccaaaggacagagtggctggagcttggccagtgaggagggccacagatggagcagggccttggtaagccatggttaagagattggatcttatttcaagttttaagccaaaggggagtctcatgtgatttaggtgtttaaaaggtgaatgcatgtttgcattttcataccacattgctgttgcttttttacttaaaccaagatgctgggggctggggtgggcaatggatatctaaggtatgaggccttattgtgtttcttttctcattcgaattgcactgacaattaacaatcagagtgaaaacaacagctgacaccaatactgtgctgtgctaggtgccttacagccttcccagcaacttgtgagatgggtaaggtgggaaactgaagcatagaaagattaagtgacttagccaaggccttacaagtggcagaactgagttccaagggaagaggctctaagaaaatcctcaggagaaactacgaaaaactagtttatgaaatcttgtctttggagcctagtctcaagacccagaatcagtaacttacagctggttaacatggttaacatgctgtgtgatctcaccttaattttccccaaacgtggaaaaggataaggcttcttattatgcaacttgacagaggagaaaattgagggactcactcctgtaatgaacacacttaggaacagagcccagatccagccaactctagagccaggctcacgctactttcctctgatgtttaaacgtctgcaaaatcagaggtgttttttttttttttttttttttttgagacagagttttgctttgtcgccccagctggggtgcagtggcgcaatctcgactcactgcaacctctgcctcctgggttcaaacgattctcctgcctcagcctcctaagtagctgggattacaggcacatgccaccacgcccagctaatttttatatttttactagggatagggtttcactgtgttggccaggctggtctcaaactcctgacatcaagccatccacccatcttggcctcccaaattgctgggattacaggcgtgagccactgtgcctggccaatacaaactttcttgattacagtgtttcacaactctggctgtacttgagaatcacctaggaagtactgaaatacactgttgatgaaaaaggccatactctgtaaaatatttgaagaaattctgagccaaatgttaggactatgacccgtgacacagcctcaggaggtcctgagagcatgtgcccagggtggttcacttacagcttggttttttatgttctagggagacataagacatcaatcaatacatgtgaggtatacattagttaggtccagaaaggcctaggtatacattagttaggtccagaaaggccggacacctcaaagctgggagtgtggtgggggtgggggtgggggtggggttccaggtcataggtggattcagagattttctgattggcaattggttgaaagagttgttattctctaaagacctggaatcaatagaaaggagtgcctgggttaagataaggggttgtggagaccagagttcttatataggtgaagtctcataagtggccgcccttagaagcaatagatggccaatgtttcttattcagacctttaaaaggtgctagactctcagatcagaaaaagtcctggaaagggaaggagattctctacagaatgtaaatttcccccaggagagacagctttgccaggtcatttcaaaatatgtcaaaaaatatattttggtgtaaaatacttcaatttctttcattacctgctgtctgtcatgtgatgctatactagagtcaggttggaatttggcatattattgcttcaaggagtctgttttgtcagtctgaatatctctctcaatgttaatactggtcagttgggcatgaattccaaagggaggagaatatattgaggcatgtctgaccttcccctttctcatcatgacctgaactagtttttcacgttgtgtccccttggctgagagaagtgtccattcattcagctggggagcttagaattttatttttggtttacaacacaacaaaaacttcccgaagtcccaggtagagatttggattttatttttctggggtgggtctccatcatgtgtctttttcaaagctccccagtttgttctccttccaggctaggtcgagaaccatcgttctcaggtagtggttctgacccaggggcatctcccaaagcttccagcctgctacgatacaatgtctggagccatttttggttgtcaaaactgggagtgggagacactactggcttcttatatgcagagatctgggatgctgccccacatcccccaacacacaccatagaattatggggttcaaaatggtaatagtgctaaggttgacaaaccttgctgtagagccttgacgatctatttgggaagacagcagggacggaaaagaaaaagggatggcacagaaccacacccctcaccttccccgaaatctgggtagcgggcacaggacgtgtgcgcctgcgcgaatgcgcgctcgccaccagcgtacgcgacgcgtgcgcgcctgtgcacctcggcgagcacgcgcccgtagtgagtacgcctgcgtaggccgccatttcttgaagccccgaactcggtcgcagtgcccgccgggaaaatgcgaccgtccacaaagtgaaatggccgcccgggacgagctcggcctcggcggggattctcttgaggccatgcccgtgccggccgccagaggtcgcccgaggatcacgaatgggcccgaggagctggctgccccttcccccgcgtaaggtctgaagccgcggccagagtggctttggggtgaccgcgcgtggaccgtcgccggcgggaggaagcgcggtcccgcgaggggccgaacggggcccctgcggcttgagcttgtttcgcagggagccctggggccatggcctctgggacactggacacgggtcgtcagggctgcccagggggagggggtgtggacgtgcagacagggaaggcagctggaccctccaaccacgctgggccctcgggctgaccggggctggtctgtggggcagtgaggaggggcttcgttccctaggagtttgatgagggagcgccatgggggtggcgtcatcctgacatcccgcagggcagtggagccttactttccctaggttacaacacagttttaactgtcccaaactgtggggactccgccctattccatcttgggccgctccatcacactacagggagaggcggtatagtatagtggttgagagcctggactctggtgctttgggttccagtccaagctctgtcacttacaagcaccgtgaccttgggcatgttactcatcttctctgtgcctcaggttcctcacgtgcggaatagtggtaatcatacctcctaccatatagggttgttgaaatggccaaatcggtttgtatatgtaaagcctgtaggacatttaaacctgcgagctaagtgaagcagcaccagaggaatatctcctcctctcagaggtgttcagggacacctggaaagctaacttaaccagctttattggtttgatttcatttgacatgacacgatatctcatcttcttcctactaaacttttgtcatcaaattttccatctagaacatgctgttttcctcattatgttgcaagcatgggcttctcgtttatattttttctgcatgaggatcaggtgaagtttaggcaccacatttcctcaccactggcaaccgttgttggccagtggaggcagtacaagggtggaagtgtcagctgggtgcagtggctcatacccacctgtaatcctatactttgagaggccgaggcgggaagaccacttgagttccggggattgagatcagcgtgggcaacgtagtgagacctcatctctacaaatattatctatatctatatatgtatatgtatatgtatatcatatatatgatgtatatctcatatatatatgtttttgaaacaatgtttcacttctgtcgccccagactggagtgcaatggggtgatctcggcttactgcaacctctacctcctgggctcaagtgattctcctgccttaacctcccaagtagctgggactacaggcacacaccactgcacctggcttatttttgtagagaggagtttttgccatgttgcgcaggctggtctcaaactcctgacctcaactgatccacccacttctgcctgccaaagtactgaaattacaggcgtgaaccactacgccgggactacaatttccgttttttaaaagaatggaagtgtgtagattatggttgtgttaggagttgacagtggctgtattaggctactggatctttggtccaattacactcagaaggaaaggcttcagagaaattaatccaaaatccaaaatcccgttggtcaccatcccctatgttaccttgcctatctctaaccacttgacttccaggaagttcatgaggagctcggacaggatagctgggaagtaattcccctggatgttacattgtccagcagagcttcctgtgagtgtttgcctaagatttcctttttatgacccacataggtcatatgtcctaaaatcacagtggccctgccacaggcctaggaaagaagaagccttgttcatccatttgtccctgtgtcacaatagagcccaaatttctctttgtggataatcctggctctatccacagacttggtgagggcaacctctactagtgtatttctacagaggacgtgggacaggacgggactctgattaaatccatagtaaagctaactcagggctaccacagtagggagacaagctcttcaggccttgtatgtttgtctttggctcaagcaagcatgtcactgacagagattgaatgggtgtgtcagggcaccctgctggcaaccctgggactggtgttacctgtgcagaccacttttggatctgcatgggctgcagcagaccctaagggtggaagcagcacagagaagcacaggcccagtgggatggttccccacagttactgtgtggcgtcacactcacttgcctgcagttctgcctggtgcagctggaggtggcaattagcttgttgtgcctgctggagaattttagttcccttgacctccacctgaggctgaagaatcatgttgctttcagggcatactttccaaaaagtgtggcctctgttggccttgttattccagcttgaaggcaggaagcctgcctagacaaagttaactcctatatacaaagagtcccagggtagtttgtagcgtgttcttgtctcggggtagcccccaccagctattgaaggtaggctggtgatgttgggaaggttatattcagagtgagctaggatcgaggtgatggcgaagtagattttcattctgaaatgctgggctcactctcttagtagcccaacttggtgtttgcccctggcctagtagactctggaagcagtaccttgcacctcggtgtggggctggtgatgggaggggtgtggaagtggaggatcagctagcagcctctttcccacggtacccagattggagggtgcagtgcaatcatggggtgaggccagggaggacccctgaagagctcgatgcctgagacatctgggggaagccctgtccttcttgctggattcaggggtggcaaaagccaaaaattggagggccaggtgcaatggcacatgcctgtaatccctgcactttgggaggccaaggcaggaggatcgcttgagaccagcctgggcaacatggtgaaaccttgtctctacagaaaaaaaaaaaaatacaaaaattagctgggcgtggtagtgtagacctgtagtctctgctactcagaaggctgagacaggaggatggcttgagcccaggaggcagaggttgcagtgagccgagatgatgccactgcactccagcctgggcgacagagtgagaccctgcctccaaacaacaacaataaaaacatcggaggcttcggcttcatctattacacatggaggcctgttcagtgagaagggagcagcgatgctgggctcctgccaaggaggagactgtctgctccctggaattggggctgtgcctggctcctttctgccccgctttcagggatatgagtccctccaagtccacaggaggtgacagccagcttgcgtcctggggctgaggcagggttagtttcagagcacttttttcataagggtgcttattcttcttcagggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcaggtaagggctgagctgcagtgggctctgcctctggagcccatgtttttgttgaggtctgcgacccacatgggaaccacttccccacaccctgtgccaatacccgacacattgcacacccaggctcctgttctgtgagtgggtcatggtgattccctggtcctagagcagtgtcatcaggcttcttgtggctcaaggagctgggaggggactgtgataggaggatgtgtctgtccccaggtgtgagaagccctggctaattcccaatgcatggggcaggaaggaaggctgtctctcagagtacaggtgctctacaggtgggggtcctgggcagagtgagggctatttgtgtgggtaaaatgccattgtcagagaaggacagagtgtgaaagagcaaaaaaacaggagggtaaaagtgcaaaagtgacagagtgaagcagagagagagaggccagagggagagaaagggagcatgtgtgagcaggcatgagagagtgacacaggatgtgactggccatgtgttggtgtgtgccactgtgcatgagcaagaggacaaacgtgcctgttactggagctgaccatgtggcattggtgtgagagtttcaagtcaggctctcttgaaggcatcttgcctgccagcgcaaacactgcatgtccttgcagctctggacacgtcaacaggccagtgattccaggggtgcaaagcgaacagtttcttacacaagacagaaatgtagaaggagagagctaagactcatattgccccgagagaggagctagtggaatccagcagggcatctgctgtggggagcaggtggagcctggggttccttttgcagggatgaaagaaacacagtcatctgccttctttgttctggggcttcttgtaccacagaggttccataattattaatagttaggttatttttagggcctagctcaactgttagataacaagttttaccttctaagaatatctagcccatctttgattccttggctccaggccctggagggtcccagtccaaaaacagagtgaacaactttggacttgctgtcacattgtgtggcttctagaactagtcagtgttccatgcagaaggggtataaaaagtgaggcttgtggatgaaggaggaggcgagtggttctgggttttgttttcgttttgcgggggagtgtcaggaaaggctttctttacagggagagtgatgttggagctgggtttggaaggctgagggagattttgccagatgtgccagacgtgcttgggaaggcattccgagtggaggctcacaaagtgtatagggaacatccagtcaggtagccatcacaaaggagggttaatccagcctggcttggcaggaagcaccaagtaggggctgggcaggcacctgctcctaggctgaggagtgtgacccacatcctgagggccttgggagccaccgatggttttcctgcaggagagtgccacagccagactcgagtccaaagaagatccctccattgccctgtggaggaccaggccaggggagtatacgacgagacaaggcaggaggccatattggagactgtttgcttacaccaggggcaaggtgatgaggctgcaagtatttttgaattattaaaggtaaaagcgggcttggcgtggtggctcacacctgtcatcccagcactttgggaggccgaggtggcagtatcgcttgagcccaggagtttgagactagcctggggaacacagcaagaccccatttctacaaaaaatttaaaaacattagccaggtgtggtggcacatgcctgtagtaccagctacttgggaggctgaggtgggaggattgtttgagccttgcacgtcgaggatacagggagccatgttcctgccactgtactccagcctgggtaacaaaacaagatcctgtctccaaaataaaaataaaaaaaataaagataacggtgagggaaaagtggtagccaaggttgctccccagatttcagggctaggcaattggatgggtggtgacaggaactagctgagggtaaggagtttgggggcaggcccgctgagagatgcacagagatgagaaggtcactgggccatgccgaatgagaagtgcctgtaggggctccagccagtgatgtccagtaggctactgagtaaacaaatgtggagttgagcaaagatctgacctggggctagagagctgggagttgtcagctcataggaagtcactaaagagaatgcatgaggttgcctggagaatgcctttggaaggcagtgtgtacaaagcatgtattctcggcttttctctgcagacttccagggacagttgtccagccaggcccttggctgggtgggtgagtccacgtggttcagggatgctgagggaagctgcttcatcagctgacatttctctccattttctgctcttcttttgtctcaaaaagaaaaaaagaggggatattaattattgatcccctaaaaccctagctgaatatataaaatgaaaagaagtaaaaatatgagagaagcaaaggcagatggaccataattttggaaaataattccaaaaggtcttaaggaggaagaggagctacagagaggtattgagaaggaaaattttggataaatggaagaatcaggaaagactaccgtcatggaaaccaagccacgctgagctaactttccagtgctctgtagatgctgaaataggcccatcagatttggctatgtagaactcatgactgccttgaggggagtaggttggggcagtgggaaaggctgtagttggattataatggattgaggagggagcggaggataagcaggtgcagttgatggggtacacactctgaaactggctgtgacgtgatggatgtgggaggggtgagcagataattacagctacaagataatggggaaggtttcctataggtgaaagcaacgtgtgcatgttaggtaaaggctgggcagagggtgcctacgtgaccagtccccgataaaatccttggactctgagtctctcatgaattgccctggtcgacagcatttcacacttgttgtcacaactcactgctgaggggaactgagtgaatcctgtgtgacccactgggagaggactctggaagcttgtgcccgggttccctcagaaatttgccttgtgtgcttttccctttgctgattttgcttcgtatcttttcactataataaaccatagccttgagtgtgatgatgtgatgtgtcctgtgagttcttcttgtgaatcaccaagcctagggatggtcttggggacccctgacacagatgggcaggatcagaactttatgccataacaaggactttagattttctttcgagggcaaagaggagccaggaaggtttgaagcaggggagtgatatggcgagagtattgctttgcaatgggatctccagtggcagtgagaagagtgactgaagtgggcagagtggagcagggagaagaggaagtgcttacagcatcctccatgtaagaaatgatggggcctggactaggggactagctgtggagatggagacagaactgtaaaataagtagaagagatcccaaattggatgacaggtaagacttgggagagcagtgacggagagggaagtgacaatttagaaagccacatttctggtcgagtgagtggagtatgtgacccctcctggcttaggtggtggccaaagtatctctaacctgcctctatactgcctgcaactgactgagcaaatgcctggtccgtggagatcccaagctgacaagggcacctgaggcaagcctctggctttcaggtggaggccctacctaggctggcctggctggattgccctggcacactgctgttttgctgaggcagacagcagcactctgcaagtgctcttctcctgttcctcttagtggtctaaatcctgtagcatgctggggtgcgactgtagacaaatcccctttccgggccccctggggttctctatttgcagtctttgggtctggtcactggcatggcatctcagtaggctaggttcatcaggaagggtcaactatgtcatggcacctgatgggcagcatttagagtctgtgggccaggggcttaagggctgcttactgctaatagttctaagtagcaagcattccctcagccctagtctgggcacacgccaggaagaaagccactagatgtgctctcctagtggataactagcctggagttccaagaagggcagagacaggcagagtgagagccttcagagatgtaggcaacgatagtagcagaacttcgagggagagtagatggaaaaattaaaaaaaatccttgtcattatttttaaatgtctgaattgaccagattagaatctttgagagtctagacactagggagatctcatgggtgggccagttattatatcatatggagggagagtacgtatgacccagcacgagaggaccagaggacagtcagtgctaagggtaaaaccttaggccatgggagattgagtttttcatcagttggcaagttttcactttaatactccactgtttccatcatttcagacgactggggatgataaggacaatgtaatttgggggataaaggaagaactcattatatttcttggatgactttactggggaaatggattccttagtcatttgaaagaagcggtagaattccacatgtggggaatacttgttctaacaaaagcttaataacattagtggcaatgatccttttatataagggaaagcttcaagccagtgagaaaaacataaataaactagtaagaacatatttataaccatgagatttgggtgcagaataaaatcaaattggcagttcaggaaaggtcctaaacatctgtatattaacaatattccatcagtgagcaatgtgaatttcccataattgaaatgatgattgataaccttgtattgttcttatctaatataaggcaaagcagcactggggctttgataaagagcaatatctcatgtacactgaggacactgaaaccccgctaggaattctatggaatttctaaaatatttatattaaggacattttacccattatagactaatttagggaaggttctgcattttttttttgatttgacaatgtttccaatgcaatttatacaatattaaataagactaattagtttttgcacctttcttgttacaaggtgaaagaactaatcctttgagattttccagaaggtccctggcaaatcccaaagccagttttaggtataaaatatatttaagttttgattgtgggaaggcaaatgttaagagttgtcaggagttctcgaacatttgattgaatagcattatgggttagcgagaaatactacttggttagctagtgaatcagagttgtaaaaattttcaagtaaacatatgaggtaacatggttgtaaagaatcttcagttcctttaaaattgaaaagactttaaaaaaataactaaggacataataaactgaacatacagatagggcattacagtattttgataagacataaaatctttgcctcttaggcagatgactcagaagaaaaacagaccatttataactttttattagggacagaccaatgatcaagaattttttttttttttttttgagatggagtcttgctctgttgcccaggctggagtgcagtcgcgcgatcaccatgttggccaggctggtctcgaactcctgacctcaggtgaactgcccacctcagcctcccaaagtgctgggattacaggcgtgagccactgcacctagcctaagaaaattttgttattttaacagagaaaccaacattttaattttatacaagtataatatttgatattagttcttttttgaaaatcttataaatacactgaataaaagttttaaccatgacaaataaaattccttttctgtgaacattttctaattttaaagatatttgtttacattttgtctcacacatttttaaattatttgtcattttaatttgggacaaagctattctctttttccttaggaaaagcatatttgcatacaaagttgtttccctttgccatttttgccattattacttttagcagtttatatatatatatacacacacacttatttacttattataattttaaccattaataacttctctttcacagagaaaacaggaggtaggtaattttgaaatatcatataccagcattttgtagcagactagtaaagcttatgaatatacatctcataactttttatagttgttatatactttttatagtaccattttgcaatgtggacaaatgaacacatttaacagatccatatgtagtcacactgtaccataaaaaaagcaaaaagtatataaacttaaatttaggtctagtgactaagtattttatcttctttataaatgatatttaatgaatttagttaacttaattcagcataagtctaaggttttaagttaccaaaaagattttagaaactgcctttaagcttacatattataaaacataattactgttgaaataaagtttgccagaataatgactcagtttggttaaaagcaaatttaaatttttataatcttaaacatgtagtagatataatactagcttattcaacatgtaaacctgtttaagtttaggaggaacatacccaagtagagtaaaaatatatgcttgtattctgttgtattatatgtaatgctgataactcaaagacacataggtgtctattaaactaacaatattaaactagttttgtttgccaaaagtttacataaattctgtgaacttgagttttaaaagcatttgggttagtttttataagaatacttttttgttgtttacactgaaagtattagaagttgtttccttaatttatgagagctttataataatttatataagtacttatttatctctaagtcaattagaatagaggataagggattttgtaaattaatttggtaatgccatctggaggtactgaactattacacatatacaacatacatgtatactaaacatacagacagacacaaatagagatctaatggcgagccctcaatgggtgcagggggcctgaagctctactggctataggcagttgagagggctgagtgggaaggggaaagcctggtgaagagtagataggggtatgtaggaggtagaggcattgaaggggacagatgaaaagattcagggagctgaagggaaggtccaaggtggtgaaaagaagggaagagggatgcggtaggaagatgagaagggggaatcttagatgagcaggtttggggagaccccaggttccctaataaggtcactgaagttccaaattacccttcgtgattactttttttttttttttttgccagttttggaaatactggacagaatgagtgccataggggcagggcatgtagtcagcaagggaggaggaggaggatgaggaggaggaagggcacccagtagattgagagttacctgtgggaagaggcagatcaaatagagaaaggagccaggctggacagtctcattaggaagttctgcacacagtcgtcatctgggagccaaagtttctcttcagtcctcattgaggagctgaagggctttccttgtgcaatctctagacaaggtgtcaagggaaacaatgaggcctcacaaaagagccaggaatttggagtaaatctccactcaaaaggaaccaagaaaacttctatccaggacgattctggctaaaattgaaaaggaccaggaagagtcctgctcaacagagtcaggggttaaatccccactcaaaaagagctaggaagagttctgtctgcgaagattcttgctcaaacagaaaagaactgggaagagctcatttaacagaatcaaagtaactgaatcacagaaccataaaaagtgtccaataaaagcaaataccgtctctgggcagggtgcaatggctcacacctgtaatcccagcacttgagaagctgagggaggaagatcacttgagcccaagggttcgagaccagcctgggtaacatagcgagactcctatatctataaaaattttaaaaattagccaggcatggtggtgtgtgcctatagtcccagctacctgggaggctgaagtagtggaggattgcttgagcccaggagttgaggctgcagtgaactattattgcaccactgcactccagcttgggtgacagagcgagaccctgtctcaaaaacaaaaaacaaatatggatttagatagagacttttattttattttattttattatttttgagacagagcctttctctgtcacccaggctggagtgtaggtgccatctcagctcactgcaaccaccacctcccgggtttaagcaattctcccgcctcagccttctgagtagctggaattacaggcgtgcgccaccatgcccagctaatttttcaatttttaatagagatggggtttcgccatgctggccaggctggtcttgaactcctgaccccaagtgattcacccgccttggcctctcaaagtgctgggattacaggtgtgagccaccgtgcccgaccaatactttatttaaaaagactattgcaatagggacaatgctgcaacctcaggacttgcaaacatcacaaaataatacaaaaaacatcacaaaataataaaaaaaaaaaagcctttttttttcagtagggagtagtaagcacagctagcagctcagctactttcaagggccagtgggcaagcaaaggggaacctgtttggcatgatttgaccagaaatgtgtttccctgtggtcagccggttctcaggagaagctgctaagtggggcatgttctgcattgcagcacttacttaaccaggagcaagcaaaattcaggccctgtggggaggacagaagcctgcctaacattctgtcaaggcaaaggagagggtaaaaagcagacagctgtgaacacttgatcatccttcaggcaataatccattctgggtttctggcttaagactcttgagaaacaaggggaaacaactggtaggagcagcaggctcacctatatgtagttccgtgaggtagccttatggacttctgccaccttccaaaactcagcatgtcccaaaccatctttatcaacacagcttctcaccaaaaacaaccaaataaaacaaattaactaatgtactaattctgtatctccccctgtgttgttcatctcaaaaaactgttatcacctcattgactcagactctcaaccagcgaggtagaagaaatgtttgggggcatgttaaatgtaacacctatgagacatgtaagaggtgaggtgcaggacgcaggtacatggtgataaaagaaaaacctcagccggattaaatttaaaggagtttcattgagcaatgaactatttgtgaatcgggcagcccccagaatcacagcagattcacagagactccagtgcagctacatggtggaagatttatagattaaaaaaaaggtggagggggggaaatgacgtacagaaattggaagtgaggtacagaacggctggattggttacaggttgggggtatgccttatttgaacacagtttgaacactcaccagtgtatgaatggttgaagtatggccgctgggattggccaagagttagctattgttacaggtacacactcctaagttaggttttcaattttgtctgcctctaggttacagtttattgacaaagactcaaatatagaactatggagtccttctcaggccgtatttaatttgctttaacaattccccctttttggtcattttctcaactttgagagattgacaaaaaccttagttattgatatcactattacccttgtaaatgtacttatatggtcttgaaacccactgggaaacaggaggacagtgggttttgtaaggagagaataaggactgagtagaaggtacctctttatgctagaatgttctgtttacaggacaaaaacaaaacctggtctgttttaataactatttgtttccttaaagtcttagtttgattatgttacatttagcatgagcaactccattttgtttggtttggtctgttgggtcctagtgcatgagctcagtacacaacaatggcttgccagaattttgtttaaaaaattccccttggctgggcgtggtggctcatgcctgtaatcccagcacttagggaggctgaggcgggcagatcacgagctcaggagatcgagaccatcatggccaacatggtgaaaccctgtctctactaaaaatacaaaaattagccgggcgcggtggcatgcgcctgtaatcccagctactcgggaggctgaggcaagagaatcacttgaacctggcagtcagaggttgcagtgagccaagatcacgccactgcactccagcctggtgacagagcgagactccacctaaaaaaaaaaaaaaaaaatatttccccttattggccaggttctcacttaggtgagagtgtgaccaaaacttagggccttagcaccacttttagttacctagttaccatcattttaggtttccagtctcagcatgtcattcataggttatgatgtcctcataatcatacatttcaatcagttttgttattccagttgaagagagaccatttgacatttcagagatggctgcatgcaaacatttgaaacctttgagagaatacagtgcactggggagactactatgactaccagtaggataatacccagagtttgaagtatgctgtttacctgaggtccccataaaacaaactgcctaaattaaataaaataaagaatgagctagacgaagagtctactcacttcactaagtgatcttttcattaatcctgtatgactgaatttttataatctgcacttgatatacatattagaattttagaaaccccatataattttggaatatatattaatataattcactaaaaatataccctgaagattaaacattatttttattggccaagcgcggtggcttacacctgtaatcccagcactctcggaggccgaggcaggcggataacctgaggtcaggagttcaagagcagcctggccaacatggtgaaaccctgtctccactaaaaatagaaaaattagccaggcatggtggcatgcacctgtaatcccagctactcgggaggctaagactggagaatcgcctgaacccaggaggtggaggttgcagtgagcagagatcatgccattgcactccagcctgggcaacgagggcaaaactcagtctcaaaacaaaacaaaacagtatttttattttgacaatgcctcccatgatttttataccaaataagccaaatgtcactgttgcattagtgcattatcgatgtcaaacccaattcttaaataaaaccttatagacaaatgtattcaatcttaatcagtttgaacataaggtaagaattttataaaccttttataaccctttacaatttttgttgaagagcagattagtgctctaagaaaacctgttgtgcttttatgtccatgttcaatttatggaaaaacctaataatacccttttaaatttagtattatcatacataaaattttttacaaggttaattttttttttttttttgagacggagtcttgttctgtcgcctaggctgacagtggcatgatctcggctcactgcaacctctgtctccccagttcaagcagttctcctgcctcagcctctggagcagctgggactacaggcgtgtgccaccatgtctggctatttttttttttttgtatgttagtagagagggggtttcatcatgttggccaggctggtctcgaactcccaggtgctcaaaggaaaatttaagacagtccatggaggagaaaggtatagacaaggtcatgcagatattaaaccagaaaggacttatttcctaagccaggaatcgaacccagactgccactgtgaaagggcaaaaccttaactactgagcccagaaggagtctagagtagttaattttgagcttgcaaaggcttttaactagtcaagataatttttagaactaactatgatatgaaccctaaaattcctgttccctggaaggtagagacaaggagaaagtactgccacatggttacaaggtcaagctcccaaggacataaaacaggatggcgaccttgtccagttttttgttggtttcagggacctgcagcaaagtttgtcactgaccagcttgctgggccatcttgagcagcaagcttatgggggcccaagcccatgttttatcctaaggtacccctcgacacagaaaaacgactttatagcacaaaatataccagattgactacagcttaagactagacagcctcagaattcctttttgcattaattaaaattttacagaggagataaacagtgattttacaatcagtttgcacagagagagagaagcctgaaatctgactgggaagagatatttacccttttgctggcatgccaggcttctgggctccctttccctgagtggccctggtgatctggctctctgcaccattgccccgggagccaagccacaacacaaaagaatttttttttaaaatgcacttcagtgtgttgttgttcatttggaatgttccactgtaagttatctttcgtaagatgtcaccatttctgtaagaatttgctgcctcccgggcgtaatgtgtaacccagaaggaactcagttttccagaagcaattaataggttccatggaatgttgatggtaagaaaggaaggaaaaggtgacaagagtgagcgtagacagctctttctaaggagtttggctgctggaaggggaagagaagcagctggggttaggtgggaggaactaagtttagagacgctaaaagtgtatgtagcaggagtcacctgatcaggttgaactgcagcaggaacaaggaagttccattttgactactattagttgcaaattggacccttatgtcaactttttcatctgtaaaaaaaaagggatggccaggcacggtggctcacgcctgtaatcccagcagtttgagaggccgaggcgggcggattgcctgagttcaggagttcacaaccagcctggccaacaaggtgaagccccgtctctactaaaatacaaagaattagccacgcgtggcagcgggcgcctgtagtcccagaatctctggaacccgggaggcggaggttgcagtgagtcgagatcacaccactgcactccagcctgggcgacagaccgaaactccgtctcaaaaaaaaaaaaaggggggcaggggatgaaaatgctattgctttccaggaatagctatgactacttccaataaagaagacaagaaggttccacatgtgaaaactacgcggtcacaacgataagtgggcgggtgcacgcacgcgcgctgagatcgtgcgtgcacaggccggggtgcggccggcgtgagtacgcctgcgcgtgccgccatttcctgcagccgcagactctgcctgcggtgctcgccgggaaatgagacgatcaacaaagaaaatggttgttttgggcgagatcgaccgtggagaggctttttctgcagcagtcccggttcctgccgccagatggcgctcgaggatcacaaatgggtctagggttctcataatggccccgcctaagaaattttggattctcctggcccttcccccctttgtggggtcaacagcggatttgggaatctggtgaccaacacgtgcgcactcccctacccttgcccctaccgagccctccagggtagcttgggggagaagctcctccctagactgccgggtatttgatgagcctggccagcgcacaggtcttgagcaccatggtcagggaagaaggctgaatggcttaggtcttcctagagaggccggaggcgggaaagaactggagaaaggagagatggcagtgggaggatggggacaagaataccagtgtgtttccagccagaagacgatgtcttttaacacctcattgaagtcgtcaggtgactttgcccttgtcagaaaggagcagcactgcgggggtcctactgaggaggagactgactgctccttggggtggggattgtgcctccttcctgtctgccccactcttggggagatgagtccctccaagtccacgagacatgacagccagcctacctgccatgggagaacaaagtctagtctcagggcactcacttcataagggtcttattcttcctcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcaggtacgagccaaactgcactgggaccttacctgctagagccagtgtttttgtccagggcagcaacccaggacaaacccccacacactaggcatgcctgtttatcctctgcaggtgagtgtggttaggagccagagggaaggagagaaaccagcatctcaggggtagatattcatgggtttcagcttggagccatagcatcaaatctgttagactaagtctggcacagaaaggatgcacagagaaccaggttgtctggcagccagttcgaacctggaaacctgggtcaggggagggatataggttgctttttctgttaatggagatggaaactctctgagcaaggtgtgccatggtgtggatgtgattcactgccagaaataacaactgtaccagttggatgagctcttccactgccatcagcactgggatggccatggatttggacagtaatgtagctccacagtgctgactcagggttgctcattgattgcaagaagttggcagcagtagcctgaggaaacaggggctctgaattttctgagagagaccaagaaccaaggaacagccaggtactagggaacagacaacaccagatgcttgtgcttttctgtgagcagctcaggtctcccaaagtggtagtttcctggcttctggcctttgtagatcagtgtggatccacacccaattgtgatgtttgtggtagctgtaagaactttcccaattttgaaatcctaggtgacttgtagcatattttttcacatttgaaaataattgagttttgaaaatgtttttacaggcaatctagtatcagattttatatcatcctgaaacattctgtcaattgtcatttccaaaaatccatggaaaactggagttgttgaactggaaacagtgtggtctcaggaagtgcttcacagccattgcaacatgggcagggcctagagggcaggagagaatgccatgatttgatgacattttacccattcctgccaggtgaacttcatctccctctctgtgacagaattttctggctctcacatccagctttggtcactgggaacccacctattggctcttgcactggcaggacatgtggtagaggcttccagttcgaggcaggactggctgcattttcaagatgtccttatttctggtattttgtggcgatcgtcctgtccacttaactgattttgacccattgccttgctgtgatctctgtgctctctctgtctcccagttccaggtcattcccttgaccagcttccagtctttcctcatcttgtccctgccaatgaagtattctggctctgccttcactctcctgccatgatccattgctttgatagggtggcttcaggaacagggtgaggagagggctgtgctagctttatcttgccaaggaactcagcaaagaaaatttttgctgacctcttgcattcctcagcctggctctggtctctcaaacctaacacatgggatgcatgccagcagccagcctcagtttccctctggtccttttctgtgtgaggccagaggtccttgctttatcactgcctggagctgcagttgatgatggtgaaagaaggtgcacgtgtcttttgagagctccctttgttccccagagatttttttttcccaaagtggccatgagtttgggaataaccaggagccatgggccgccggctagagatgctgcatactaagagcctcctgtgagcagccatgtacacagtgaacacgatggctaaggccccatccagccgccctcaaagagcacatagtccactaaggaataagcatgatcgtaataaccattagcacctgctgtgtgctgagaatgtgcaggcactgttctgcatgccttatgtggactcactcatttaattctcacaccaactcaaggaggtgcttttattatggagaaactgaggcagatggaggttaagtaatttgctggcagttttgcagccaggaagtggcctaaccgagattagaatccagacagagatcagagcctgtactgttcatcgctgtggcatccatactgcccctccatttgtgataagcccaggaaggaaagaaaccaggtgctctgatggagaggggttagagcaaggatggttagggaaagcttttctatcgaggaggagacagttcggctgagacctgaaacatctggaggagcctgccttccaaagaacctggggagaggcattgtggacaaagaagatagggaggagggcctgaacaatgagccctgtgcttggagggtacggggtgaggtgagcagggggcaggagctgggccctgtagggtcttgtaggtgagggagaggaggctattgggagggctcctattgctcacattgcagtcctggggggatgcccagggcattttttcttttttttaagaggcggtgtttcactgtgttacccaggttgtttttgaattcctggcctcaagtgatcttcctgcctcagcttcccaagtagctccagggaatttctgttttaccttgcctcttcagttgcgccgtccccttcagtattctgctgacatggatcacaggataccagacacctggtagttgttcagtcagtaggaggtcttccttccttcctcttagaatcaatccttttctcacttgttggctctgcattttatcccccgtgtatcttttcagatttttgtggggcctcctctcccatccagtccaccttctccagtctctatggtatatttctttgtcatagggtgaagcaggaacaggtacaggatgattgggtacactgaggtgaggtaggagggcaggccctcaggaagggcttcccagaggaggtgatattgtctgcaaaggcatatgagagcctggaagtccaggggaactgcaggctggtctgtacggcttgagtggcacgtgatacagtttgagactatgaggcgagagagctaggcagatgctagaccatgattgttcttccctttccccactcttcaactagttgtaatcttaggcattggattctctggcaaggggacaatacccagtagcctgggccagatggaggcagccatatctggagtatgatctgagccacagcatgttggagaaaagccagaatcagcccagggcagtgtgcacccatagtgctggcctcaggcctttggagggtgagcagacttaagttggaaggtgcaaacaagtggtcagtggtgctgcccaacatcgtgccctgaactgcagttgacagctacggcagctttggtaatgaggctcatagcctgggggcaggcagagtgagagccgatattggcttggccagagaaaagcccttttgggctgccgaggaggttggattccaggccaagggccatatctggcagctgaagtgtggaggttcagaaaaacttcgacaccggtcagtttcccgcctctgctgggaatgaggtgcatctgactttcctcctcaatgatgcctaatttcatttggtcctctgccccttggccttgtgttctctagagagttccctgcagggtggcagaaggagctgatcctagtaagggaccgtcccatccagtgaggaggtgagctgggctgtgtcttccccttctgcaccctcctgactgtcacatccccgggagccccatgattccactctaactgagtgaatcacagaggccaaggcccttggctgcagtcaggagtactgagtggacactggaagattggggtcttgctactgactcacgatgtgacctgggacatgtctcaactcacctagcctgggtttgcttatctgtaaagtgagaagttccatttgttggtcttggaggaagcttcaagagcagtgctcaagggttaggctcagaaaagcctgtttgaccctggaaggtgtcagctcccaggttgacgtgcccacccctccctttatttctttcagggtgaggagcccctcgagctgcatggtcactgttactgtcactgccacatctgagcagcctcacatttatattccagcccccgcaagtgaattggactccagctctaccacgtaagaagggctatctagcaacctgggagatgttcctccgc

SEQ ID NO: 1031 - DNA, 36 bp, mus musculus
ccgggtcatcctcccatccccacccgcgccttgtgc

SEQ ID NO: 1032 - DNA, 2865 bp, mus musculus; identical to SEQ ID NO: 159

SEQ ID NO: 1033 - DNA, 2865 bp, mus musculus; identical to SEQ ID NO: 159

SEQ ID NO: 1034 - DNA, 960 bp, mus musculus; identical to SEQ ID NO: 161

SEQ ID NO: 1035 - DNA, 28526 bp, mus musculus; identical to SEQ ID NO: 162

SEQ ID NO: 1036 - DNA, 195 bp, mus musculus; identical to SEQ ID NO: 163

SEQ ID NO: 1037 - DNA, 415 bp, mus musculus; identical to SEQ ID NO: 164

SEQ ID NO: 1038 - DNA, 2070 bp, mus musculus; identical to SEQ ID NO: 165

SEQ ID NO: 1039 - DNA, 2151 bp, mus musculus; identical to SEQ ID NO: 166

SEQ ID NO: 1040 - DNA, 10295 bp, mus musculus; identical to SEQ ID NO: 167

SEQ ID NO: 1041 - DNA, 4990667 bp, mus musculus (residues 1-1,663,556 of 4,990,667)
  misc_feature (1341778)..(1391777): n is a, c, g, or t
  misc_feature (4586815)..(4636814): n is a, c, g, or t
  misc_feature (4712453)..(4762452): n is a, c, g, or t
actgaaaaaacccatgtcctcaccttgcaaaaccctggggcagctcgcccaagccgtagagcgggtataaatatgggctcttgccataccgggccagggactcactgtacaacttgatgcggttgacggtctcaaggcagggctggtccaggtagctgggggaatagcagcacccctgatttacccccacccaggtaccaggccagtcttcccaccaccctgaatggcctggggaagatgaggatcaaatgcaagggggaaatggaaagggtgataggtgagcctgtggctgagtacaagagacatgcggggcagggggacagcaggcaggtgtgggaagggtgggggcgggccgggcgagggggctgccaccacccagcttcccctcactcatcagtgcggtagagcgccagggcatggccagtgaaatcgatgacatcctggcccagatcaaacttccggtagacgtcacgcatgctggtagtctgggggtcaacgccctcaaaggtcttggggtcattctcatcgaagtttgccacaaacaccaggaacttgcggaagcgccgtttctcaaacatgcccatcagatctaaggaacgcggcgggaggaggttctgcatcaatgcagcacaaaactctccatcccagcagggcaggcacccccactcacagcccagctgtcctgtgatcttaggttaacctcttcaccctttttagcctcagtttccccacctggatgaagaggggattggcctggatgggctctaagggccttcctggctcagacacttggcgatgtctcggggattcagtggaggccctgccaaaggctcaagtttttgttttttttttttgagatggagtctccctctatcgcccaggctggagtgcagtggtgtgatctcggctcaccacaacctccgcctcccgggcgcaaaccattctcttgcctcagcctcccgagtagctgggattacaggtgcatgccaccacacccagctaatttttcgtattttgagatgagacggtgtttcaccatgttggccaggctggtcttgaactcctgacctcgtgatccacccgcctaggcctcccaaagtgctgggattacaggcgtgagccaccgcacctggccaggctcaagtctttcaaaaggagccccgttcccctccacatcacatccctgctgtgtgaggacctccctcctggcagccagccgtgcagcatgacatggggcagagggaatacagagtgaagggcctctctggtccttcacgggaaatgtgactttggacaagggggtgccttattctggacagccacccatcccaaagacagttggcttccctgccaccccatgatttctctggctcagggggcccacactcactggaagccaaggcctcagtctcagtggacggcactttgtagatcttgccccccttgtagacaaagctgccctccaccaccttgaagtccaggtagcgagtcacctctgtatacagtagcatctttaccagctgccctgtgggggtgcacaagggcaacatcagcacggctctctccagaggctctagctggtctggccgtgcctcctctggagcctgaccgtcctcgggtcttccctatcacccccgacctgcaatacctccttcctgtccctcaccgttagccatgaggaatttgggaatcaggtcaacattccagtctcggcctcggcccatcgactcagggggcccctccagcaactgaaaacgcttatacagctgtaagcagaagggagagagagagacacctcagggaccacctcctcctgctccaggcacctggggagctacttccaccctgtgccgctatgtgggaggttaacagggataggcttgggcctgggcagcctcacctcctccaggggtgtgatggaggagctctcgcccccgtagtaggggttccggtccatgtgcagcaccttcttcccgttcacagacatgatgcccgacaggatgcattcctgggggagggtgacaccatccgctgcactcccacctgcctccgctcctaccagcagacctgatttgttccccacccaaacctgcctcagtggacagctccttccacccaccatccccactggctagttgcctcgcctaaaattggggtgatggcttcatccgaccacactctccattgcaaccttgctgggcaaaggagtcccgtccccctcacaaggcggagagtgaaataacggaggctttgagggaggcagggcatccagcagacacaggatggccttccagtaccaacacgccgagaggcatctacctacgcagagccgcacaaaaaggcggataaaacacaataaggcacagagaagacccagctggactgcaaaggacactcgaaagggaggaaaagaaaggcttagcacagtccttgaaattgtaggccccaccctggactgctctttcttcaaatagcaggagcccctgccgctgaggaggggcatctgggcctggaccgaggaagaagagtctctgaggggagtaggccaacggggttttcggggaaagggggaagataaacaccctcaccagtcactgtcactagcccaaggacaaaggctgcagatgctacccagcctgaggtctccatgggcaaccgaggtggggttgcgggaatgtgcttactgcccccactgctgttccttctggaacattccctggatcccctggccccagaagacgatgaggaggcgggctgagggcccactctggcgaggccccctgaccccaggtccttctacttcatccccaccgggattagcgcaagatgggaagggacgctgagaggcaacgctaggcgggcaatgggtgcgggcgacgggtggatgccgtgatgggtgggggcgatgggtgggcggggtcgtgggcatcgggccgagtgggggtgcgttttccggtccagcgggcaggggtagggaagatgggagggcgccgggggtcggacccgggtagcccaggaggcggccaggaagggggcctcttcggggagatggggtcatggcaacgagcagaggcgacgtcgctgggggagcagcggggtgggcacggcgccggcttttcggggagcggagcgcagaagatggcagtgaccagaggatgggccggcggccgcatcatcgcgggggatggcgagggcacgacgcagggccaggggcgccggggccgcacttacggtgagaccggtccccagcacgatcacatcgtattcctcgtccatggtcaggcctcggtgccagcgcccgctcggctcctcctcctccttcaccgcagcagtcgccgccgccaccgccgccgccgccaccgcactggaccaaagatggcggcgcgtcggccgtcgcccgacccctccgccgcgtcaaagagtcccgcctcttcccgcgccccgccgcaaccggcaggggccaccgcctccccggctcgcctcccgggagggctgccagggcccgggccacagcaccagcgcggctccgcgggcgacgctgctcgccgagagtctagagaggcgcggggcggggcgggcggggcgggccggcggccggtgctgcggcccaggaagaatccgtgcgcgggagccgcgcgcgccccgccccacccgccgcgccccgccccgccccgccccgcgcgcgcccgcccacctccccacccccgcccacccccccgggagtctcggcgcggccccgcggccgggcgcgcgccgctgcggcagcctggggcggccccctcacgacgcgaaggctgccattgtcacgacggcctcctgagacgccgaagcgcaccgggactcggcccgaccgcccctccctaccctgagcggttagggcccagcttgctaaagcccctcccggtctccgcggatgcctcttcgcctccccctcgccaggctccatcctcccgcatccctccggcgagcacgcgcctaaagcccagcgcagaaatgagcgacaagaggcccaacgcatggcgacccgcgtttattttattaggaaggaaacaaccaagcaccccatgctcctgcccggcactcccggtgggaacatgccaaacagccggcgatcgcacccagcccacctgtcgtggaggtcccttccttctcaggccacagaaataaacccgtgtacttcttattgttagcacaacatcaccagaaaacgataacgacagccaagcaggacagacagttaagtagtacttccacactcccaaactcagggagccctataaccttaaggagggagcatttgctacacaaaagcactatccacagccagggatgatgtagccacaagaataaataaggagaaaggagaccctagaattcatgtcccttacgcctcacagcgacgaaccctgggaagctggttggtctagcatctacgcagaatatgtacaccttgttgggagagatgggggcagcccaagaaagctcctcagcgggctgaagagggagcaagatgggctgaggggagcttgcagttcatgctgcagtaggaagagggaagctcttcagtccagtgcgctgcagggtgggaaagcaacaacacggacaccgtcccaccctcaacccccccactggcacagggtcacacaatctgggtcaaagaaatagtggggcccttgtggtcatcaaagcgatccatggtcttgaggctgaggatcatgtgcaggccataggtgaagatgaagagcatgaacagggaggtgagcagccccatccagatgccgggggagaagaagctggcacagtcgctggcgtaggagaactgctcccccattacgttgaaagcctggatctggcagacacacagacacgggtcagaaaggaccgttgggaggcccagcaagaactgggacaggggcagcgcagggacaggactctcaactacatgcccaagcccaagcctctcttcgtctctcaaccactagcctgggctcccccacctgaagctgggccacgcccgctccatacctggaagtcctgaagcatcatctgccagggagagggctgcgtgcgggccacgaggagactacccttcttgctcaggctgctgacatactcgcagtggaaggagtagatgctgggccctgtgacctgggaagcattgaagtaggcgacggagccattgctgtggacttcgaggcgctccatggtaaaccagtgccgggcagacactgggtagaggcggttggccagaatgaacctggggaaggtggcagggatgtcaggtgagctggggaggctggggccacaccagcccacccatacctcaaccacccccaggactcacttgaatgtcactgtggtaccaaagagtcgttcataggtcagtgagagcctgtggggccagagaaagaggcgcactgtgaggctctgggagggcctttggcatcttagaggaacaagttcctcagctctgctcctacctaagctgccttgggtccttgcagccacctgaagaagcagtgtccccacttgacagataggaaaactgaggatccagtcacattgcaaggtcggaacagagctggaagccaggacccaggtcccccttgccaccagcatgggggtccttcctctggttcccctgagctcactgcccctccttttactccctcttagggtcactaaggtgcctgggctgggctttgggggcgagagcaaacagaagggcatggttgccccataaatggctcagatagctggcctggtatttgcccacacaaagtcccagaggttttgctcaagggggaggtgacaggttcccaggtaaccttgaggtgttaacaaccaaggtcccaaccaaagactcgcaagcatggggaggcagaagtctgagcaactccccctccaacagcaccccatgccatgacacctcctacatcctcacgctgcccagaccccaaccagaccatggccatccccaccccaaaacacagacctgaccctggctccctgccccacctgcgacccacagtgatgggaaggtcacctgtggtggcacagtcctccccagcctagtgcccttgcctggcaaaggagtcattccagaaggagccagtcaggttgagttcctgcaccccaaaggtgaggggagtcaggtcctcccactggtccttgtacgccacagagaagttttgggcccagaacaggatccggggagcggtgtcattgtaactcacaggaggatggatcacaggtgatactggctgtttttgtagcagctggcgacctagccctccggccaccacggctacatcacgggccacctgcagaaacacccaaccagccttctttcagcagccctgggagagtgtcacacttgaacccaattgtcgtgccctccttcccctcccaacaggacaccctgtccactatctcaaagtcccatcagccagaggagacctttcctccaggaagccttccctgatgccccctaaaccctgatgacattcctagtccctcaaacttagggtcatttagacttagtgtccaagtctgccacccacaagcctcacaggacgagatggaaagctgcccctggaatggggaggcaggacttgagtgctcatcctagccctgcccccagagtcagccactccaaatagtcacaccacaggggttctgtgcctcatgcttcccctatgctgggcctcctgggcagcctacctgtggcatacactccccacctccaagcagactcaccacactgcctctccctgcacgccccagagcccctgctggaagggcacataccctggaagggcggaccgctgtgagggccgctgtgtatgggacatcttcggacttgagtgtgctcaggacctgcccgatgacctcatctgagggtcaacaaggagagcagagactcaggtcaccaggcaccctgcataaagaaacactccccactgtctgctttagaaaccttctagaccatctgaaagtggtgtgtttactttccactgaggatccttaggagcagctacttctcatcccacccccattcccagcctcccccagagacaactgtggcttcagtcatcgattccctaatgccaagccctacctatgtgacataagaaaatacatatcaatacagaaaactccacatccacccatgaaaggttcacgactgcctttccatggggagtgactgtcctttattgcaaatagatgagtccccagaattgtttttccaaatgtctgcagtcttattaaacccataactctaggattcacgctgcctgcacagaaactggctccacagcctccagcacagagagccgcccccctctgccaagtggggtctggctggacagggtcttctgtcaggtggtccctggctggtcctgggagccagcatttccctgctccactgccagctgccccgagaagcaggcgggccaccctgggagtgaggaggccgaggaactgcaggccagctctctctgtggcccccacccaagggctagatgaggacgtgcatcctccctgattctactcaccgttgcctgtgaggacttccctgggtgccatcagaccagagctatggaagacaaacagagcgccagagtcctcaggcggcctggacctgcactgcccactacccttccccgaccccagcttctcctccccactagccccacgcaccaagcctgcacactcttacctcagtgccccctcctggaagcccatcccaccccgaggcttctcagtcacactcaagtcctggccacctgctctgtgacaagggcctggctaggtgagaaggctccccacccgcagggctcacatctgcctcatctctggaggcccagctcagtgctaggcaccaactcctgagtcacagaagaggccctcccctcctcttctggccacacagggcaccttctggaagggctgtgagggggtggggagtactggcatctttagccaaacggtgccaccacatgccatagcccagggccttgctgctctctgggccccgaggctggtggctgggccatgcgggcagtacctggctgtgtagggcaggcgaatgagcagcagagcagggaggctggcattgagcttcagctcccgcagggtggccaggtccacatgcaaggggctggccccgagcttctcctgcaggtaagtggtcagagtgctgactgcataccagtcgacggcaggaagcaccagtgaggagggggccaggtccagggcattctggggacaggggagaggcaaaaggtgagttagccaggggccagtgggcctggcccagccccccacacctctctggcagctctcctctggcaagccatacccataaaggctcaccaagaaaatggcccacaccccagcccctgacattcaggccccaggcctttctaccccaaagccagcgtctctgctccctaagagtatgaggtggcttttgttgttgttgttgtttttgggggggatggttgacccagaagagactcagacccaagtaaccctgatatgaggtcagagtacagttcttatgctgggagaaggagcacagaatgtcccccatggcccctggctgggagaggactctcacctctaggttagaaaaggcgctgtcctgcttgtttccaaacacaccgccatatgctgtgaaatcctcaatgctcagctattagggaaataggggagacatctgaggaggtttggcaagtgatgggggccaaggcaggggacagccaccttccccgtgcattctcagggccagcaaagtctcactgagagtcaggttcagtatggtggagcgcaactgtgtgttggtgggggtggggtgggagactcacctcttccctccagcactctcagggcagggtgagaagacatggaaggcagtcatggggtggggagatctgcaggcagctgacttgtggtaactcaggagtaggagtcagccgccttgcccaccctacagacaagaggaactggggagggaacagggaagctgcggggagggggtggggcagccaagagcatttgtggcaggcctcccagccagagaaaaggagagtcggctatgtccagtctggacgggaccctccccccacctgcttttggcggaaggggagaggtgaggatctcagaacatgctggaggaagcatcgagcattgaagtcttttgagctcttaggaccacagtggccccgaccccatccctttttctccacaacctacagatgtcctttgtccttttgctcctaccctccactcccatccccagcttcctctggcccttcccagttaggccctgaggagattttaatcagcttccctaacctgtttggtatacacactcgcccagcctcccctcccttgtgggcaggaccttgctgctgtttggccaccggggttctcagtcggaaagcccaggaactgctggtgggtcctgtgggctttctttaattgagaaatcacaccactccctgctccacgttacccaaggctttctcacacatttcgaactgcaactgaccttccccctcatggcctacaaggtcctacttcatcgcctagccacctgcaaaccatctcctacatctcctacccctttctctcactcactgtgctccagccacaccagctcttccttgagctggccaagagcacacctcgcccaggaccctcgaatttgctgttccaggaatgtccttccccaaacggctccctccctccattaagatcgctgctcatatatcacctcctcaatgaggcctggcctgaccacccttatctaaaatagcatcccagtcactctgtccccttagcctgcttccttccctaaaggccgtaacactgacatcatatcctataccgacttagtatttactggccaccctcacaagaatgtcagcttcctgagggtgggggcttgggttcttctgctcactgccatatccccaacacttcacaatacctggcacatagtaggctttccatattgggcaaatgaatgaatgggtgaatgccctaagactgggggatcctggctagatgttttatgtggattataagaattccccctcacaggccgggcgcggtggctcacgcctgtaatcccagcagtttgggaggctgaggtgggtggatcacgaggtcaggagttcaagaccagcctggccaacatggtgaaaccccatctctactaaaaatacaaaaaaatacaaaaattagctgggtgtagtggcgggcgccctgtaatcctagctactcgggaggctgaggcagagaactgcttgaacccgggaggcggagggtgcagtgagctgagctgacattgcaccactgcattccagcctgggcaacagagcgagactccgtctcaaaaaaaaaaaaaaaaaagatttcccactcacagccctctgatataggtggtgtcttcattttacagatgtagaaactgtcattcacaaagattatttcatgcctccaatggctggttacatggtagaactaggactcagttcctatttgactatattatttaccacctcctgaaaagacttcaggccaccaccatctgcccacacagcaaccaagggagactacaagggcaatgagccatacaggccaccaacaagggagggcctagcagagacttgctatcttagagtcatctcatggtctccacgcctgcttttggggcaaagatcctggatgggaaggaaaacagcatgcgggttatgagctccaattgggagggaggattggcagactcaggctggaaccaaagtggtatctatcaactgtagtgaaacattgtatctcgacaaaccttactttccttggcagtgaaaccaagataatgacatcagtgtagcaagtgcctacaaagcactaaacaggtgagcattttccaattatcattattatgatcatcacagctagaattacaactctgccacccattagctgtatgagcttggacaagtcacttaacctccagcctcagtcttctcatctataaacaaacagggacgataatccccacccaccatattggactaagtcagatatccaaagtgcttggtactcagtaggtacctggcctctggtccgtcgcttcctccaatcaagttggtgccatttccgaggctgtcgccatgcccactgaagcgtttactacaggccttcccatgagacgacccacacctccctacagttgggacaaggtcactgaagcttcccttggggaatgggcgtcagtgtcatggggggagggggcctggctgcctcccgatgaccgggggagagtgggctggggcgggcgcaccttgtcctgcaggaacagcagcacattcctgggacccagctccagggcgggatctaagtaggtagagagctgcaagtcgctggtgatgtggccttcatgagtgtcggccgcaggagcccacaagtccctggcagggcacagaagaggtgctgtcagacgggggcgcatgtggactggagctctgtcgccggcagattcgctgcgagcccccgagcaaggaacagtccacctccgggcctcaccacccctcgcctaggacagcgccggagtcgggcgagggcgcctcagccgccacagcgcatcccaccccggcccgctcaccggtcactcgaccacagcaccagcgggacctgctgctccgccgctgccgccgccgccgccgccgccaacgacaaaaacaccggcagccacggcatgcgccagagcgcctgggcgcatcgcggccccatccgcactcgagccgtcgccatggccgccatcatagcctcagcctccactgcctcagcggcctcgacagccgcagatcaggtgaccgttgcccccgcccgagccccgcctcgcacctccattggccccagcgcgggccgaccggcagggccgcaggtaattggaccaagtgcatgccactcgcggccactccttctcactggttggctgtacgtgtctccaggcgctcacgctccgagtgggaaaggggatggggcccagctagaccgactaggacgagacaagagggacagggaggcttcgcggaaccctacgcccacccgacgcgttcgcccgtccgtttttatttttatttttattttggtttttttgttgttgttctcttcttttgtcttttttttttctttagagacggggtctagctatgttggccaggctggtctcgagtccccgggctcaagcgatcctcccgcctcagcctccggaaaagtgggactacaggcgcgcatcgccgcacccggccaatccctgttttaatccttttccttaaaattgcaaaagtggtgtctttttcctgcagatggaccctccctgatacaggtgagaggagactgtaatcccttagaacgaggagtgaagcgggctcaggatagcatctaggggaacacccagcacttacattgggcaggaggagaagggtccagaaaagagatcggacaaggagcaatcaaagaggaaggagaaaacccagagcgaagcgtggcatcaaagacaccctaacgggccgggcgctgtggctcacgcctgtaatcccagcactttgggagcccgaggcgggcgaatcatgaggtcaagagatcgagaccatcctgcacaacatggtgaaaccccatctctactgaaaatacaaaaattagctgggcatggtggtgcacacctgtagtcccagttacacgggaggctgaggcaggagaatcacttgaacccgcgaggcggaggttgcagtgggccgagatcgcgccactgcactccatcctgggcgacagagtgagagtccatctcaaaaaaaaaaaaaaaaaaaagattgtagtcatgattgtcacatgtgattcagactaggactaggatagtggcagttgagctggagagaggaagtgggtctgacaatacagtcaaagaagattgtagcttttgggtctctctgagttggggactgggagacgaggtcacttgggggctcactgagtttcgggtgcttagggaaacccccaagtggccatttccaggccttaactagctgaggagagaggttttcactggagcttcactgtatcccaggagaatccagcaaacttaaaaaggaaagcatgtctattatgtttctgttacttttgttacatagtttcaaggcaaatacttcctctggaatgcggaaggcaatcttgcctccgccaggactctgttgctgagctgcttccatgcttagggaagaaacccacctgtggctgcttttattcttccctgcattgctaggggtccctggagtgatggccctggaggcttcctgaagcacctgctatgggccaggcacctggactctgccccggaagttgacagtttggtctagaggacatgcaggacagcaggtcatgatacagggtcatgaatattccaaaggttgagacatgggactgggagggatgtaaggagaggggcaccgatgaagctgctcccaccaggaggtgatatctaaactgaaccaatcaccaaatgttgacagcaccaatgagcaccttctgtctggggacttcatctttagggtaaaagcattttgttcattgaaatcctggctgggcgtggtggctcacgcctgtaatcccaacactgggaggctgaggcgggcagataacctgaggtcaagagtttgagaccagcctagcaaacatggcaaaaccccgtctctactaaaaatacaaaaattagctgggcgtggtggcgggcacctgtagtcccagctactcaggaggctgagacaggacaattgcttgaacctgggaggcggaggttgcagtgagccgagatcgtgccattgcactccagcctgagcaacaagagcgaaactccatctcaaaaaaaagaaaaaaaaaaagggccgggcactttggctcatgcctgtaatcccagcactttgggaggccgaggcgggcggatcacgaggtcaggagatcaagaccatcctggctaacacggtgaaaccccatctctactaaaaatatgaaaaattagccaggcgtggtggcgggcgcctgtagtcccagctactcgggaggctgaggcaggagaatggcgtgaacccgggagatggggcttgcagtgagccgagatcgtgccactgcactccagcctgggcgacagagcgagactctgtctcaaaaaaaaaaaaaaaaagcacttctatggtgaaacgtaacccaaaaaagaaaagaagtaggccaggcgcattggctcacgcctgtaatcccagcactttgggaggccaaggcgggcggatcacctgagggcaggagttcgagaccagcctggccaacatggtgaaaccccgtctctattaaaaatacaagataattagccgggcatggtggcatgcgcctgtaatcccagctactcgggaggctgaggcaggagaatcgcttgaacccaggaggcagaggttgcagtgaccagagatcatgccattgtactccatccagcctgggtgacagagcgaaactctgtctcaaaaaaaaaaaaaaaaaaaaaaaaacccacaaaataaagatgtacagtgtaatgcttatcaaagcagacagttccatggcatcacccaggtcaagaatttgaatatcattgccctgaaagcccctctcatacccttactatcacttcccaatgtgaccatgaacttgattcttatgctaatcactttggtctttatagtttgaccagttaagcatgcattcctaaaaatgatgggatgtgttgttttggctgttttgaggctttaaataaaggaaattattcagtataatatttttccctcctccactcttttttttttttttttttttggagacagagtttggctcttgttgcccaggctggagtgcaatagcgccatctcgggtcactgcaacctttggattcaagcaattctcctgcctcagcctcccgagtagctgggattacaggcatgtgccaccacgcccggctaattttttgtatttagtagagacgggatttcaccatgttggtcaggctggtcttgaactcctaacctcaggtgacccacccaccttggcctcccaaagtgctgagattacaggtgtgagtcaccgcactcagccttctcctccactctgaagggaagtattattttgtgtctagattctttgctcaacattggcagattaattcaagtggctgcatgtaacaatgttgctgcatagtattcccctggatgaatacgtcaccattgattgtgtccttcaactgttgacatttggttggtttcccatttgggctgttatggctaatgctgctgtgaacaattatgtatacgtctttctttttcttctttttttttttttttttgagacggagtctcgctctgtcacctaggctggagtgcagtggcatgatctcagctcactgcaagctccgccttccgggttcacgccagtctcctgcctcagccccctgagtagctgggactacaggtgcccacccccatgcccagctaattttttgtatttttagtagagacggggtttcactgtgttagccaggatggtctctatctcctgacctcaagatctgcccgcctcggcctgagtgcttggattatgggcgtgagccactgcgcccagccgatgtatgtgtcttttgttaaacatagatgttcatttcaataggtatataactaggtggggaattgctaggtcatagagtatatgcactgggttgagtagtgtccccataaaagtcattgcagacagaatcaagttaaggtgaggttatactgcataagggtgacccctagttcaatcaatgcatggtgtttttaaaggaggagaaaaagagacagacacagggaggagagcactgcacgcagctgaaggcagagattggaatgacacctctgcaagccaaggaacacggagcattgctgggaaccaccggaagaagccagaagacaggcctggagctggctttccctcacagccccagaaggaacccaccctggtgccaccttgatttcggacttctggccttcagaactgggagagaataaatttctgttgctttaaacttcccagtctctggcactttgttactgcagccacaggaaacccataccatgcacactctgccttttgtgtttcctcttctgtgaaatgcctttttttttttttttttttgagacggaatttcgctcttgttgtccaggctggagtgcaatggcacaatcttggctcactgaagcctctgcttcccgggtttcagtgattctcccgcctcagcctcctgagtagctgggattacaggcacccaccaacatgcccagctaatttttttttttttttttgtagagatgggggtttcaccatgttgtccaggctggtctcaaactcctggcctcaggtgatccgcccacctcggcctcccaaagtgctgggattacaggtgtgagccaccacgcccggccttaaccacttttaactgtacagttcagtggcattaagtacgttcacactgttgtacagtcatcaccaccatccatcttcagaactcttttcatcttcccaaactaaagctctgtccccattatacaatttcccattcccccatcctcccaggccctggaaaccaaccttctactttttgactctggatctgaagccggtaagtacatcatataagtggaatcatataatatgcagccttttgtttccggcttattgcagttaacataatgtttcttgaaaatcctttgagagtatccatttgatagcatgtatcaaaatattcctttttctttcttttatttttaatttttttttttttttgagacggagtctcgctctgttgcccaggctggagtgcagtggcacgatctcggctcactgcaagctccacctcctgggtttacgccattatcctgcctcagcctccagctgggactacaggcacctgccaccacgcctggctaatttttttttttttttttttttttgtatttttagtagagatggggtttcaccatgttagccaggatggtctcgatctcctgaccttgtgatctgcctgcctcggcctcccaaagtgctggattacaggcatgagccactgtgcctggtgtgtttttttgtttgtttatttgtttgtttgttttttgagatgaagtctccctctatcgcccaggctggagtccagtggcacgatctcagctcattgcaacctctgcctcttgggttcaagtgattctcctgcctcagcctcctgagtagctgggattacaggcgtgcgccatcacgccagctaattttttgggggttttttgtttgtttttgagacggagtctcactctgtcgaccaggctggagtgcagtggtgtgatcttggctcactgcaagctccgcctcccgggttcacgccattctcctgcctcagcctccagagtagctgggactacaggcacccgccaccacgcctggctaatttttttgtatttttagtagagacggggtttcaccatgttagccaggatggtctcgatctcctgacctcgtgatctgcctgcctcggcctcccaaagtgcttggattacaggtgtgagccaccaggcccagccttttttttttctttttttgagacggagtttcgctgctgtttcccaggctggagtgcaatggctcgatctcggctcaccgcaacctccgcctcccaggttcaagcgattcttctgcctcagccttcccaagtagctgggattacaggcatgcgctaccatgccctgctaattttgtatttttagtagagacggggtttctccatgttggtcaggctggtctcaaactcctgacctcaggtgatctgcctgcctcggcctcctaaagtgttgggattacaggtgtgagccactgcgactggcctaatttttgtattttagtagagatggggtttcaccatgttggccaggttggtctcgaactcctgacttcaaatgatccgcccaccttggcttcctaaagtgttgggattacaggcgtgagccatggtgcccagctgcttctatctatatttaattacaagtgtttgttttttcccaggtaatttttttccctttttggtcatttttttaaaaaccttttattttgaaataattaggcaccaacgctgctgaaagacctggttgtctgaatcttctcttgttgctggctcatctttggtggttctatattttctttctttccacgtttctgttatagtatttttaatactgtgtctacgccaccaccctggatttgcctttgctcccacccaggacccccagctccatctgggcaaccccaatcctacctcctgatcacagcgtgcactgctcatggctggctgcttgccgggctcttcagagctcctctcccacctatgatgcagcccaggtaggatccaattgattctccacacttgggtctctctgaagtgtggccccaatctacctggctagctttgggttttgaagcaagttcattagcctcactccacctccttggcaaaatgagattaatccctatttctgcaatgttgttacagggattacagacaataactgaagccttaagtgactggtgcagaagaggttgatgcccatctgctcaagtgtgctccatgtccccagggcactaagggttcagcctttctgtccagcagtcacttcccattttcacccctacagagaggccagagacattttacaacaagccaacacatatgctttatggttctgtttcaaaaacatgaaaacccaggccctaggattcaagtgatgttgagaggcagaaaggatggagaagttgttggcgccagcatgggggcaagcagccagacctcaggccctcactctaggctccacgtggctgggcttgacttctggccaagggctgcttttcccgcctgcggcccacctgaggccagaccttgcctgaggaaagggcctgtggtcggggggaagctcaggcagaaggaagacgtggccaacggccatccctgaggaggtagtgagcagctcctggttcggcaagggcggtgggtaggagccaggccgaggagtcttagggtcccctctccacagctctggtgggccccctgctcccctagccaactggttgctcacctgccttctatgctccctcctgaagccagcccctgggagagaacatctgaaggcaagaaggaaagagagccctgcctaagcttcttcctccctgcttggccaagtgggagaagcagctgaggtcctttgtgtaactgaggaagcacggaggagctggaatgcctaccagctcggagagggcacttgagagggtctatgaacaaatctgtctaaaagccacgtttgagctaaaagcatcagtccatccctcagccccagctctgtgcgggccaagaatccagaaggcagcaagcaaggcctatctcccaggctggaggtggttgtggagctgctctgcctgagtcttcagatgctggaattcctcttgaatgaagtccgtcagggctttccgcatctccacctgagggaaaggaccagggatggcctgcacccctcgggaagcttggccaaggtgccctgggagggtgccctgggagggtgacgggatggagagggtggaggcaccctgctggaagccagcagcagggggtccggggacagctacgggggacccaggaggaaactcacagccgacttgttctccgcccggagccgctcgagtacaggcagggcactgaagggcttcccgatcagcacagtgattttctgtggggtggccgccaagagtgatgaggagcagtaggagtgcccacagccccagcccaagcaacccgggagccagaagctaagccccggccctgctgtgccacacactccccaggggccactcttcctctaaaacaaggtcctggtcctgggtcctgtgctgtagatgacctgtcctgtcctgaccccacagcccacctctgccccagcctgacttcctctgctctcattttaatgtctcggtgccaggaagtccctgtctatgttccactctgtcccctgctgtagcctcatgctcagctcctcctgcagctggcctccatagtgctgagtgggagacacggagcagacagcagacaggcagacagccgaaggtcagcagtccccacccacctgtccaaagcgggggaagtagggcggactgttaggaaggacgtcattcattcctgcagcacagtggacagaaggccagacgtggggtggagcagggcagcctgggaccagagggagtcccaggccccccaccccagatgccatctctctgtccccgtccccaggctcaccgacatgccacaggggcaggatgatggggttgagatgacactcagcaatcaggcgcccgattcctgcccaggggggaggtagaaatgttagcataagctgggccctgagccaagcttctgtgccagcctctggccactgccacccccgacatcctccagttcaattcagctcccttgggcaagcccctgcgagaggcaggcctagtctcagcacctgtccccttcctggcgctacaaacacgcccatctacccccatacaagccagcccgagggggcgggagccaggggcccacagggccatctctgggccgggaggatggctgtggccagagaccagcagcccttaccccacttgaaacgcaggaattcggaactcatgttcactttccctggtgagagagcacagaggcgaggcttgggagcccatcccgctcatactgggggggctcgacccagtcagccctgctgaccttctgggaagatatgcacccagtccccatggttgagcttctccaaaatgaagtccatccccttctggtagacgccatctcctgcaaggaaaaggcctctccctatcagtaaccattctcgggggcgtggggtgacaggttagcttaccctcaacactctccaaacctcaatgaaacaggcccttctccctggggcccatgtgttggggactatccccctcagtccctgcttgctgggaaagccccagcagattagggacttcccatcccccactgcgccatccacagacgccctccaatgaccgtctccagggcctgcatggcacttgggcacgctgtggggcttccttcctaatatcttctaaacccctatgtgccaggcagcatcagctcaagtcatctcctaccgagattctgacctggcaattcctccatctacctatgacccccatcttcagtggctcaccagctgggccgcttcagccacatactcctgcacactctcaaagatccccaggtcagcgcaccacctgccctccctccccagccaggccctggctgccagccgaccgctctcggagcctcatgcgttcctttctctttgaaggtgccactcctgggctgatcctactatgtgccagctgctagagaaaccaagtgcatttgtgatttccaacctcgcttaggccccagattctgggcaacaaccctttgctgggatctcagccgcttgtcacagccactcctcacagggcacctgcctgaggcctcagcctccaccattcctcccccctgctgaccccttcttctcagggcaccccgggaaactagaccctcccttatagggaggtctcttgggaaagggagaacattcatttgaacacacatcaagagcttgggaaaaactcaaacttgctagactgaaaaacagtggagtcaaactgctcctggtctagcaactttccacattggagataaccctgagaccatggcactggacccaagagaaggaaatgcaaacctccttccttctgaagccaatgttggctgctgcgtgctggctggaagcctggggatgcttggagacagtaagtacacagtaaggatctcatcaaccttggtgatggaaaagtaatcacatggcagacaaaagaggaaagaggtggagaggttgaaggaatggggtatagcagatatcctcatcttataaagtggggagtaaagaagccctatcacagagcgagagacagacattgggaatacctttggcaatgaactttgttctctgcaaggccgattctttggaaggtgctagttagggatccaggaatctcaacccaacccaaacagtgccctgacccagcagcccacttgggctagagggagggggtgatgacccactggagtttccctacttgggacgcagcatgtgtaatagtacaggggagtcttcataggtactggccccttctctactaaaacccactgacgcaacctatccattgagcttgaaactggaatttaaaaaataataataatatgcttttggagcaagacttcatcatttgtagcttttgcaaatgctactactgctcacttgtgtcacttgtgtcaaatcactttgatacttaaataccatattaaaatctacgcttggagaaaaagggaattttttggaacacagaagccaagtgtgccaaatactgcctttgccttaatgacatattattagttctttgctgaaggaactaaagaggcagggacgaggggtgaatcagcagagtccccatctctcagagcaggttgggataaacaatgccacggtcatttgccaagacactgtggcctctgcttgttcctttacagagacagaagttcctttacagagacagaagtagcctccaaaagcagcagaaagagaaaccgctccagggggctgcttctgaggagtggggctagggaggtgaggggcaggcactgcagctttccattaaaagcccctctttgttatttgctgttactttattgggttttaccacattctactttgaccagctagaaataataaacccctccttgacctctaatatcctttggttacccttccttctgtctctttttcctccaaactgaacctctgggaggagttgccgcccctgcggtctccattcccccgctgcggtctccattcccccccaactgcagcaccaccagccctcaggccataataatctggctctggcagctgtcactgcatggaaacgcttctccagcatcacctgctgcttccatggtgccacaggcgcctggtttgcttttctctctggccatggctccctgccatcttggtggcttctctctccctctgtgccatcctgggcctctgccctctctctgaagactctcactctgcattcgtgactttgtggtttttgtggttgaattcccagtatctttattcctgataattttttgttttttttttttttgagacggagtctcgctctgtcgcccaggctggagtgcagtggcgcaatctcagctcactgcaagctccgtctcccgggttcacgccactctcctgcctcagcctcctgaatagctgggactacaggtgcctgccaccatgcgctgctaattttttatatttttagtagagatggggtttcaccatgttagccaggatggtctcaatctcctgacctcttgatccgcccgcctcggcctcccaaagtgctgggattacaggcgtgagccactgcacccagccccctgatcattcttctaagttccagaactgcacaccccactgcctctgggactgctctccttccacaggtgaggggctcctcagatgcagcacaagcaaaacaggactgaccctctcccctcccagcccccgcactgctttccctttgcacccttctccccgtggctcagctccaacacctggtgtcatctttgagttctcttcctcaccccacctacacttaatctatcaacaagtccagagtacatcccaaagaagtccccttctccggttctccaacgtgacacttgggaggcccagccacaatcatctgctgctggagctactgtgacagccctgaactgggctcctcatgtccacctagccctgctgcagccacattgcaactggaatggtatctctctcttttttttttttttgagacggagtctcgctctgtcacccaggctggagtgcagtggcgcgatctctgctcatagcaagctctgcctcccgggttcacgccattctcctgcctcaagctccgcctcccgggtttgtgccattctcctgcctcagcctcccgagtagctgggactacaggcacctgccaccatgcccagctaattttgtgtttttagtagagacggggtttcatcctgttagccaggatggtctcgatctcctgacctcgtgatccacccgcctcggcctcccaaagtgctgggattacaggcgtgagccaccgcgcccagcctcggctaatttttatatttttagtagagacggggtttcgccatgttggtcaggctggtctcaaactcctgacctcaggtgaaccacccgcctcggcctcgcaaagtactgggattacaggcatgagccaccgcgcccggcagatactacctcttaaccacagatacaagcatgtcaccacctggatgagagagcacagtcaaatacaaaaatcttttttttttttttttttttttttttgagaccaggtctccctctgtggcccaggctggagtgcagtggcatgatctcagctcactgcaacctccacctcctgggttcaagcgattctcccaccccagcctcccgagtagctgagattacaggcgtgcgccaccacatccagctaatttttgtatttttagtagacagggtttcgccacattagccaggctggtctcaaactcctgacctcaggtgatccacccacctcagcctcccaaagcactgggattacaggcgtgagccaccccacctggctatctaatctatctaatcaatctatctatcttatctatctatgtatgtatgtatctatctatctatctacctacgtacctacctacctatctacccacctacctacccacctacgtatctatctatctacctacctacctacctatctatctacctatctatctatacctggggtctcactatattgctcaggctggcctcaaattcctgggctgggttgggcacaatggctcatgcctgtgatcccagcacttgagaggctgaggcgggaggatcgcttgagtctaggagttcaagaccagccctggcaatgtagtaagaccccaactctaccaaaaaaaaaaaagaattagctgggcacactccttagtcccagctgctcaggaggctgaggtgacaggatcccttgaacccaggaaacagaagctgcagtgagccatcatcacgccacggcactccagcctggacaacagaaacagacattgtctcaaggaaaaagaaaatcgagggctcaagtgatcctcccacctcagcctcctgaggagctgggactgtaggcatgcaccaatgcagccagctaattcaaaattcttttttttttttttttttttcagacggagtttcgctcttattgcccaggctggagtgcaatggcaggatctcagctcaccacaacctccacctcccgggttcaagcaatgctcccgtctcagtctcccaagtagctgagattacaggcacacaccaccacgcccggctaatttttgtatttttagtagagacggggtttcaccatgttggttaggctggtctcgaattcctgacctcgtgatccgcccgcctcggcctcccagagtgctgggattacaggcatgagccaccatggccggcactttttttttttttttttgagacggagtctcactctgtcacccaggctggagtgcagtggcgtgatcttggctcactgcaagctccaccttccgggttcacgccattctcctgcctcagcctcccgagtagctgggactacaggcgcccactaccatgcccagctaattttttgtatttttagtagagacggggtttcaccgtgttagccaggatggtctcgatctcctgacctcgtgatccgctggcctcagcctcccaaagtgctgggattacaggcgtgagccaccgcgcccagccagaatccaaaattcttaataggattattctagaaccttcatattctacatacaactcatattttctacctttcttttgtttaaaatatttttatttttaaagagacagggtcttactatgttgcccaggctggtctcaaactcctgggcttgagtgatcctctcacctcgacctcacaaagtgctgggatgacaagtgtgaaccgctatgcctggcttacctttctctcttctttttccagcacctggcatgtgcctgcctgtgtctagaacacctttcccctcattctctgcttggaaaaattctgctcctgcagaggaaggagcaatctggattcaaatcctggctttgccacctcctaccccatgaccttgggccagcagcttaatctctgtgatcctccctgtctggagaatagggatcaaaatggcccctatcccctggggttctcaccccacaagcctgtttgttctcctagaagcaaaaccctctggcctgcaggtacatgctactgccaccatggaccaatgacaacgcactgttctcaatgagtctcttagtgacatccctgagagaaggggttatggataatgcctccttgaattctaatgccaaggctccaggtccacaggatccctgggcagttgcagagagttgaggactttccaaggacccatccctcctcccacagcctctgtcccctctgctggcatgtgatggagctgggcctcatgttggctcccgggatgcctacccccataggtccctccaaaacagagacactggccaccagctttcctgccccagaagtgcctccctgcactcgctggaggagcagctcacctcggcacacaggcacacacttgcccaagctgaagaagtgggagtgtagctccttggtgaagcagatgtctgcagctgcaggggtcctaagcagggacagatgcaattagtcctgccccctgcaccccgctccaccaccctgcccccagcatcagcatgcagaagggaggcacaggggagggcctgcggggccccaccccatgccctgcctggactgctggacgccacctcctgggcagagcaggaggagggcaaatctgggcagaggcaggtggggccggcccggcccacttcgaggggcccattcctcctcaccaacgcatcaacttcaggttccagatgtggcggagtttcaggatccctagaggacaggaaaggcttcatgccccaacttcccatatccccagggagtgcccttccttcaccccatctcagggaatgagggacagcagcactaccatttccctacagcccaaagtggcatctttcagacccttaggccagatcattcagttctccctggctcctccctctcccccaccctccacatcttactaatcactgcacctggactgcctacctccccaacatacttggacaatgcccattcttctatacttctccctgtactgtcactgcaaccagcccagtctaggctagtggatggctccaagtcctccttcctggcctcccaggatccacctgtgacatctataggcctttctccacccagcagccagggtgagctctgaagggctccagtgtggctaggtggctccccatgaactctaggacagttaagctctctgttcaggagtggaagccccaggcacccctccacccggccatctggttaccagagccaagcaacttcctgtgaagtcagcagagcaggaacctctaggtgtggcaaccaggctcccaaatagggctgaacggtacacgcccagccaggggcaaacctgaagccaggacactgggcttccagtccctggcccagaacttcctcacaggatatcctatgtccaacccccaaatttttcccaagactgtggggccctggatggtttagagaacagagggttctggaggcctgacgttaaaggagctgtaagatatgccctgtggccgttccttggtcctgctccatgcccaaggccctctccaaatcatgctccctcagggatgctgcaggagccacaaatccaagtctcagccctggggcagaacgcccggaaaccggagtgccagggctccatgaaaaggcagcgagaaggggtttgttctgacgaggctgggcccgtcccgaatcctcgcctttcctccccctgcccagcacactggcccgggtaccccagagatgagggtcgtccatgcaggactggtgattggacacggtgatgaggggcgtggccgggcctcgcttctcgatgagctcgtacagcacctccctgttgtgcacggtcaggtggttcatgtactctggcggggaaggagaggtcaggcgctccgggctcgcccgctaggtcggggccgcggcgtcccccaccctaagtcccacctccggccgggcatgggtacccgggcgggcctgcctcggcctgggcccactcactggtccagaagcagctgtaggtgcccaccaagcccatgacgacgctgctggccagggtccaggtgagcggcggcaccgcggggaacggccacttcacgtgcagaggcatccccacccggcccgcggccggcgctcccagcgccccgggccggcctgtggggcgcctctaggtctgcgacctcgaccgctcgagacactggcccctgactggcccgcgcacggacggacagggggcgcggcgcaacaggggactggaccgaggtcccttcgcaggtcaggccggagcagcgcccggccccgctctctcgtcactggggagcggtcgccggggtcacaggccgtgggcgcgctgcggaacgggaggaaacgggaaggcgggcgctggcaccccggcccggtgcaaccgccggaaagcgaacctgcgccggtgcccagcccgaccgactgtcgcaaagcgcgcacgggccgcttgacggcagcgaggccagccccggggcggcgggaagtggccgtcaccccgtggggctcccgcttcctggcagcctcctgcgctcgccttttgtctctctagtgtttctgttttttgtttgacacagggtccagccagacccaggctggagtgcagtgatgggatcatggctcactgcagcctcgatctcccagactcaagcgattctcctgcctcagcctcccgagtagctgggaccacaggcgcccgccatcacactctgatccacccgcctcggcctcccaaagtgttgggatgacagccgtgagccaccccgcccagccacatatacaatttgacatagttacagtactacatgatactatgtgtatgtagcaatgtataatctactgtatggcaaaatatacaatatatacagcaatatatacaaacatattgtgtatcatatgtaatacaagaaacagtattttataccatctgatacagtcacaatgtcagctactacctctagttctgaaacatattcatgacccggaaagaaagccccctatgcattaagcagccagttttttatttttattttatatttatttatttattattatttttttaggagtctcgctctgtcgccagactggagtgcagtggcacaatctcggctcactgcaacctccgcctcccgggttcaagctattctcctgcctcagcctcctgagtagctgggactacaggcgcaggtcgccacgcccggctaatttttttttttttttgtattttagtagagatggggtttcaccatgttgcccaggttggtctcgaactcctgagctcaggcagtccacccacctcagcctcccaaagtgctaggattacaggcatgggccgccgcacccggcagttttttatttttatttttatttatttttatttttgagacagagtcttgctctgttgcccaggctggagtgcagtgacgagatctcagctcattgcaacctctgcctcccaggttcaagcgattcttctgtctcagcctcctgagtagctgggattacaggcgcaagccaccacacctggctaatttttgtatttttagtagaggctgggtttcttcatgttggtcaagctggtctcgaactcccggcctcaggtgatctgcctgcctctcctcccaaagtgtgagtcatcctacctggcctgttttttatttttaaaccataatttattgatttttttttttgagatggagtctcgcactgtcgcccgggctggagtgcgagtgcagtggtgtgatctcggctcactgcaagctccgccttccaggctcaagcaattctcctgcctcagcctcctgagtagctgggattacaggcgcccaccaccacgccgggctaattttttgtatttttagtagaaacgggtttcattatgttggccaggctggtcttgaacgcctgacctcgtatccacccgcctcagcctcccaaagtgctgggattacaggcatgagccaccacgcccagcccataatttattgattttttaaaatttgtccagccttctattaccacgtcgaatccattagctacagccatcccatgagaagctgagtggattcagccccacctcctgctcacagaccctgtccgagcacctcatttgtcccaacagcattactgcaggacccccaggacgttggactgccagctccctgggtctcctcctctctggggcagatcctcagtcctcccttgacttcacgactgtggccagatcatgtgtggactgtccctctctttgggtctccagagcgcttgcatcaaacacccctaactcagaagtgtgcagccacactgggactcagaacccaacaacagggacagaagactcacgcccttggggtgcccggtctcgtggcatcaggcatgacttccagctcctgcgccttccccagcaactgctgactggggacccagaccgggagctgagcgacgggcctggcgagcgaagctcggggtctcactcaggcaccagcccctccttgccccaggcttgagtgactcacaggtctgtcatgtcccgctggcccgggaaggcggggtctgggtgggaaggtgggcgggcaggtcagcagttcccaggcctggtgctggtcctccttgttggcggcgaggcggagacggggcgggcctgcctgttggcaagggtggggcgtccggcccagccaggcccttcctggccgggtggctcaggaacacagcctcttcctcttttttttcccctcctagccctattcaggcaggagctgctcttctggggtatcgcgatccacttaaggatgaggcagacttggtgacaagctggtctgagcaggtatgggagccccctggggagacggaagaagggaggaagttgccttctgcctggggagggtttgagagggagagggaagcctagggctcccaccaaggctgatattgacagccagggtttggggctgaagccaggaaccgtcactctctctggttcttactggtagccctcatgggggtccctgacgccagagcctccaaggctgcatgtgccagcccagggctgcccacatacccatgtatatcccagaataggcaccagggtagggaacccaaactagcatgagtgacagagcaggtggtcagggagaaacagacatcaaacccagccaggagagagacaccgcaacagagagacagagaagggaaaccagagacgagagggaaagtgagacagagacggacagagcctcagagaggtaggaagtgagcccgaagggaaggtgacaggttgatagagaaaagcaggcagacagagcagaggaactcatgcctcaggatgcaaaagccacatggacagggcgtggagcaaggagccgagccctgcaaggtcaggtgagtgtgagacaaagataaactgagagagggggcctccagctggtgagatgaacaagaagggctccccagtggtggcaggggcatgggaaagagtccccatcacaggttgcaatggggatgatttggccatatctgagaccttttaaaatgcacacacccttcactgccgggagtttatcttaaagagaacatctcacaagtggggagacagagatgaacgaagatgttcctgtagttgctaatggaggcgaaaagcactggggtcttggaacaacatggtgaaaccccatctctccaaacaaattttaaaaattagcttggtagccgggcgcggtggctcacacctgtaattccagcactttgggaggctgaggtgggaggattacttgaggtcaggagtttgagaccagcctggccaacatggtgaaaccctgtctctactaaaagtacaaaaattagccgggtgtggtggcacgtgcctgtaatcctagctacttgggaggctgaggcaggataatctcttgagcctgggagacagaggttgcagtgaactgagatcaagccactgcactccagcctgggagacagagtgagactccatctcaaaaaaagaaaaaaaaaattagcttggtgtggcagcatgcacctgtagtcccatctactcggaaggctgaggtgagagcatcacttgagcctggaaggtggaggttgcagtgagctgagatcacattactgccctccagcctgagcaacagaatgagactatcaaaaaaaaaaaaaaaaaaaagggggggggctgggcgcggtggctcacgcctgtagccccaactactcaggaggctgaggcaggagaatcacttgaacccggaaggcagaggttgcagtgagccaagatcacgccactgcactccagcctggtgacagagcaagactccatctcaaaaaaaaaaaaaaaaaaaaaaaaaaaggtagactaggccaggcgcagtgggtcaggcctataatatcccagcactggctgggcgcagtggctcacacctgtaatcccagcactttgggaggccaaggccggctgatcacctgaagtcaggagttcgagaccatcctggccaagatggtgaaaccctgtctctactaaaaaatataaaaattagctgggcgtggtggtgggtgcctgtaatcccagctactcgggaggctgaggcagggagttgcttgaacccaggaggctgaggttgcagtaagccgagatcacgccactgctctccagtctgggcgacagagtgagactctgtctcaaaaaaaaaaaaaaaaaaaaaaaaaaaaaaaaatcccagcactttgggaggctgaggtaggaagatcacttgagtccagcagtttgagaccagcctgggaaacatagaattcaggaggctgcagtgagctgtgatggcaccattgcactccagtctgggcgacagagcaagactttgtcccaaataaataaacaataaaagaataagcttgaccgcttgtgcactgttggcgagaacgtaaaatggtgcagtcaccatggagaccaatatgacacttcctcagaaaattaaaactagaactaccatatgatccagcaattccacttctgggtatatacccaaaagaactgaaagcaggggctgggcgctctggctcacgcctgtaatcccagcactttgagaggccgaggcgggcagatcacgaggtcaagagatgcatgaggctggggcaccagggctcattcctgcaatcccagcactttagcaggctgaggcaggagaattgcttgagcccaggagttcaagaccagcctgggcaacatagtgagaccttgtctctatttaaaaaaaaaaaaaaaaaaaaaaaggacacggtggctcacacctgtaatcccagcactttgggaggccaaggtgggcagttcacctgaggtcaggagttcgagaccagcctgaccaacatgaagaaaccccgtctctactaaaaatacaaaattagctgggcgtggtggagcgtgcctgtagtcccagctatttgggaggctgaggcaggagaatcgcttgaacctgggaggcagaggttgcagtaagccgagatcgcaccattgcactccagcccgggcagcaagagcgaaactccgtctcaaaaaaaaaaaaaaaaaaaccagatggatggatgaatgaatgaatgaacaaaatgtggtctacccagatgcccagacaatggaatatgattcagccatgaaaaggaaagaaattctacagccgggtgcggtggctcacgcctgtaatcccagcattttgggaggccgaggcgggcagatcacgaggtcaggagatcaagaccattctggctaacatggtgaaaccccatctctactaaaaatacaaaaaattagccgggcgtgtggcaggcgcctgtagtcccagctactcgggaggctgaggcaggagaatggcgtgaacccaggaggcggagcttgcagtgagccgcgtttgcgccactgcactccagcctgggcgacagagtgagactccgtctcaaaaaaaaaaaaaaaattctgacatatgctccaacatgaatgacccttgaggacattttgctcagtgaaatgagccagtcacaaaaagacaaatactgtaggatttcacttttttttgagacggagtcttattgtcgcccaggctggagtgcagtggtgcgatcttggcttgatcttcacagagcaagactctgtctcaaaaacaatttttttttttggagacagagtctcactctgtcacccaggctggagtgcagtggtatgatctcgggaggtcactgggaggctggtgctgggcagcagctagtgccactttctctgttccatatttcagcgcttccagagccagaactgagcccagtgagagcgcaccctggagcagcctggattcctggggtgtccccggcagccacacacagccatgcactacccaactgcactcctcttcctcatcctggccaatggggcccaggcctttcgcatctgcgccttcaatgcccagcggctgacactggccaaggtggccagggagcaggtgatggacaccttagttcgggtaagttcatcacttcagggaagccgtgcccctaaccaccatgagccaaagcccccatccctgcctgaccaggggtatgttctagagaagaggggagaagaagaggtgtggcacggagatgcagcgcaggcgcttgcctgctgctggcctcagtctcctcctctgtgaaacaggtgacatgtgggtgggatgagtcttttcctggggcatttccagtcccactgctttctgtgggctgcagccagtgagccttaacactctgggccacaacagtgccagtcccctgggcccactgcctcctctcagggcagttggcactgagtcaggctggccttcctgatgtcccacagatactggctcgctgtgacatcatggtgctgcaggaggtggtggactcttccggcagcgccatccccctcctgcttcgagaactcaatcggtgaggaagattctgtgggtctaatcaggggcacacccagaggcttgaggccctgaccccgcctccccttttcttggcagatttgatggctctgggccctacagcaccctgagcagcccccagctggggcgcagcacctacatggagacgtatgtgtacttctatcggtgagcacggagctggcagcgcagcagggtggggggcggtccttggccctaatgtgaggtaggctcattagtccccggggccacaggccccccatcctgggacagcctcacctgctttgcatgctttctcttctcaacaccttttattctgggctcttcccatcctcgacccccgccagagtgtccatagagcaggaggccttccttctataagcacaaatgtggggtccctcctcctctctcctgtgggagctgctggggctcagggtgtggctggccccctctatgaaagtggccagcaagggctgcagctcctgggaagaggctccgtggggaccacttatgggccttgggtagacccgatcttctaagtccctgggaggacaggctggcagggagccctttggagtcaggatccagagggcaagggaggctgcagggaaggagaactgattctctatataaataaaatgatatgacatctggtatgcgctccaaaattactgggtaggcagggtacagtggctcatgcctgtaatcccaacgctttgggaggctgaagcagcaggatcacttgaacccaagagttcaaggctgcagtgagctatgattgtgccagtgcactgcagcctgagcaacagagtgagaccatgtctcaaaaaaaaaaaaaaaaaaaaaaagaatgacatcaaagtgtccaaatgtcaaaatgtactatacccagtccgtggaatattattcagccagaaagaggaatgaagcacagacgtgccacagcatatggacgaacgcagaaaacattgatgagctgatttcattcatatgaaatatccagaataggcaaatgtacaagatagagaacagattaatggttgcaggggctggggggaggggagaatggagagtaactggtaatggatgttatgtttttattaggagtaatggataccaatgttttaaaattgattgtagcaatagttgcacagccttatgaatgtacaaaagaaccgtgttgtatacttgaagcaggtgaattttatggcatatgaattatgcctgatttttgaaagttctagagacaggttgggagggctgtgcccacattgccgctgttagtggagggcccctccctgagcgccgtttggcacttgcaagccaaaatcaaagacgtggggccactgctgcccatccctttgtcctcccaggtcacacaaaacacaggtcctgagttcctacgtgtacaacgatgaggatgacgtctttgcccgggagccatttgtggcccagttctctttgcccagcaatggtaggaagggaagggtgggcttggtatgtgggagcagaaggggagttctggctggctccactgggggcttcctcacccagacgggctagggggagaaggtccaggagtggatggcagccctcggtccctgggccttgcagtccttcccagcctggtgttggtcccgctgcacaccactcctaaggccgtagagaaggagctgaacgccctctacgatgtgtttctggaggtctcccagcactggcagagcaaggtaggcctgggcagtttgtacaggagggacaaggatagggtggcccagcggccagcctgatggctgctgtgtctctaggacgtgatcctgcttggggacttcaatgctgactgcgcttcactgaccaaaaagcgcctggacaagctggagctgcggactgagccaggcttccactgggtgattgccgatggggaggacaccacagtgcgggccagcacccactgcacctatgaccgcgtcgtgctgcacggggagcgctgccggagtctgctgcacactgcggctgcctttgacttccccacgagcttccagctcaccgaggaggaggtgaagggatggggctggcatgaggagggagggcagcagcagggtcacagggaagcccctcggccccgggcactgacactgccccaccacccattcccaggccctcaacatcagtgaccactaccccgtggaggtggagctgaagctgagccaggcgcacagcgtccagcctctcagcctcactgttctgttgctgctatcactcctgtcccctcagctgtgccctgctgcctgagcgtccccctacccccccagggcctgctgccttttgggacttaaaccccagcctcccccgtccatccagccctggggctggggggcttcaactatagttgccctgtgactgtagtccacccctgcctgccttgtttgatttggctcttgttctttggttgggcttgtgcctagattaggagaggaagccaggggccctgcactcatgccacctgccaggtagtgtagtatcaggagtggagacaaagtgggctctgggttggggtaggggaagggagggttcagaaagaggaatgaagatgttgtatgacaagaaggaaagttactgagaacaaaaacccagattggtgagataggacacttgtgcagcagatatgccaatgggccatgtttattgtggattggtaagaatcaccaggaaaccattaagccccaatagctacaaggagggtggttaatctgctatatcaaactccttccctgaaaccagcaaacaccgggaaacattttggctcattataatccggtgaacaatgcagtcaggcctgttataaccgctgagcagccacactcgcacctcctgggtgctgtagtctgtgttggtacaggcttctgcatgcctggtaaagtccagccaaggctggtcaaggcaacatctccacacagaaaatctgcaccagttatgtaagctaaaaagctgtgtgaacccaggtgtcccggaaaggggctgcaggacacagcaaaatgccagcagcgtgccggacccctcccttccatcctcctctccaaagaacagaggtcaggaaaaacactggctgggacgctagaagggtcatgtgttaactataatcacatttatggtttggaaccatcaccccaaggtaaaaaaaaaataaaaggtattcccaggtatgtttggcaaaataaaataaaggtaattaaaaacctaagaaatggctgtaaactgagattacaaaaaaccagaggccttttgggagccacaggctgggggctggggccaacataccccagctctgggaccaaaagcctttggagtcctgtccctggatacagatgctcaggccacccacctagcactcctctcatttttgctgctcccccaaaagccagcgctgttctacaatagttcaggtcagacatctaagatccccaggccaaaccatgccacacacgtgtctgttccgaggtcttgttacaaatgaccaaaggttagcctagacctttggtcaggtggtgaaggccctgggaatgcaggttctagaaggggtgggggcatggggcccaggaggttgctagagataggaaatggggcaaatcgcaggtgacctcagcagtacctggatgattcccaccaaggaggaatggccaaaccagatgggtgagaacaagcccaatgtgatgcacacctacccttgctaaataaacgctgctggtcagcctctagcccacaagcccctcttggtccgcatgtgttgtaataagcaacacaactgtaggctgaccccagcctgggattgcaaggctttgctgcagctgtgcttcatgaaaagcacttcagtgtttttcaacctactgcctaggacctggggaggtccaagtcaagctccagagtagacaactgacataaggccaccagtcccagccctttgcagggtttgctgcctcatgagcagggctgagttgtcaacctgtttctgaagtgaaagggcaatgacccaaaggttcccagaggaagttccttccccgtcaagaatgtagatacaaagacataggtggacaggaagtagaatttattggtgagtattaagaggggggcagcacattggaagccctcatgagtgcagggcccgccacttgtccagagggccacgattggggatgtacttgaccccacagccatctgggatgagccgcttttcagccaccatgtcttcaaattcatcagcattgaacttggtgaagccccacttctttgagatgtggatctaaggagcaatggaaagaactgagtcaggaggcctggggcaaaggtgggagaagggggctgcagcactacataccttctggcggccaggaaacttgaacttggccctgcgcagggcctcaatcacatgctccttgttctgcagcttggtgcggatggacatgataacttggccaatgtgaaccctggccacagtgccctggggctttccaaaggcacctcgcatgcctgtttggagcctacattggggtagtgcaaggtcagaaacatgaacatccacctgaaaggcctgtctccaaggtcccttagagcaacccatacaaccaacaggctgcgtacactaccaaggaagctgctgtgtgcagccatcgcacactgggtccccatgaggaaaggaactcagtcggcttaattggctgcggagcatcccaagaaccactgaaaaggcgccactgggctcctctgccagcttcagctacctgctggcaagatggttgtcattcagctaaaagcaagaagagctactcccatcaccagtgtttcccctaacctgtggggaagagcttgctaagacttactcatgctttgtttgtatctgcaggaaggggtcctgagtgaccactgaaagtcacttgccagcctggcttttctagtagccatagtggctgagtcactggggccacctctatgctctgataaaataatgcaagcctaataatgtagagactccaactgccttaaaaggcccagaccaagctcacctgtcagccccagcacaggacaacatcttgttgatgcggatgacgtggaaggggtggagccgcacccggatatggaagccatctttgccacaactttttaccatgtacttattggcacaaattcgggcagcctccagggctaggtagggagaagaaaagcagcaaagtgagagaagataatagagaaacattcaccacgactatctccagctcaggggaactgtgttggctgagttttgtaaggctcatgtttcatcaactcccaattccagtgcagtgtatgtgggtggggttgagggagcacggaggaaggactggggggtgacgaacaaagaatcctgccttaccttcagaggacagctgctcatattcatctgacaccatgtggccacaaagcggaaactcatccacttttgcctttttccgccccaggtcaaaaatgcgaatcttggcatctaaaaggattgggtaagtgtgcagggggtgtcacagacggacgcggagtccgcagagccaaccagtgcaggggctcttccactacttaccagggacacctcggcagaagcgagactttgggtacggcttgttcttacaataccggtaactgcaggggagtgaaaaaacacaggttaggtgaggttcacagaaagcccaacaggcactttgcccctcaaggaacaacccaaacgagggacgggaaaagggtggggaatgcacgtccacttctaaaccgtttccattcggggaaataaactacaaagcaacagttggctgctgcaacacagacaacacccaagactagaaacaacagacaccatcttccgttactttgtcttacgcttcctataaacactttgcaacaaactttcctagttaaaaattctctcttcaagacactgcgtactacaaaatcgccgcattatcattgcacagctcaggtcacccaatttaagactttcgggcacgtggcactaaatccacctccaagccgagtggaaatgcgtctggcgccccctgtaggacacaggaggcggccgcacccgtttttcccggactgcccttcacgtccgacaacgcacgcggcacgtcgcccggaaataagacagagaacgcacacaaaggccccaagagcgtatctagcgcccgaaaatgcggtgagcttgcaggacacaggcagagatacgagggaaccgtcgcttccacaccgacacgggaacgaaggaacagacagtaatattgcagactaaaaaatagccgggaggtgtaaaacatagggtcagttcccaagacagggccgccgcacgggggaggctccaccccacaattgttttcagcggccataggcacttctttccccgcccgtttcccagcagtgaaagtacacggattcaagactcaccaacgggcggggcggcggcccatggcgacaccaggatcttcagtggctgcaacgaaaaagagagagtcggaacggaagacgagaacagacctaaaaggtgtgagaaccagcaacggcaccgcaagagacgacaactgcgcttactcaccacaccgaagggaaagaggcgctcctccgcctgcgcatggcttatataggcggtctgtctgcgcgcgtaagaaccatagagtcctgtcgaagacgggtggacgctctgtcagacgtcatgaccatagacgcagccgctcttggcgcttgcgcccgggcgtagcccagcacatgcgcagatcagagaggtgaccgggtaccagggccgcgggcggccagctgacgaatggggcttcgccacatggtcgcgagaagcccgcttccggctggccatcttgggcgtagaactcttgccctaggctttgccgttaactgtgacagacgtatatttctgagagtggaaaaaaggaaagtaccctaggtgggcctcccggcgaccgcgagagtgtccctgagcttgcacgggtctcggacacgcgctccgtgcctccttctaggctagaggccccggcggtgaagcgccatacggggatctgggcccgcgttcctttgtcaacccgggaggccggagggggagacccattcccctaccggagaggctggaccaggccttgctgggagccatgccccgtatccccgtttcctggagacccagggttcgcacattgccgcggggaagaggtcgaggagaaatctccacggagactcatggcctgggaaaccccggggcatctctagccccgctccgcccaccctgacccgcaccgtcccgaccagctgcgtctcgggcgccgcctcccatgagccgctctcgcctgggcaccgccccacctcgcccttcccactccactgtgctcaagagtccctccgggtgcgtctgggggtcgtggggaagcagggccgcccccacccgcccacggggcagcatccggggagaggtgcgcagagcaggcgggcgtcctgggggaagtggcatctggaggtatctgtccaccattctgcaggtggggcgcggtggggtaacaaagtcttcccgtcctttgacaggaaggacgggaggaaatcctgctcgagcgcacctgttttccaggatgatatgtcgcttttataaatggctgcaggtccctttgagaaaagcttgggacgatttctggggtgcacttgcagcagtggtgcaaggtccttcccaggggaacctagcctccctttccatcatgggactctggatgccggcggtgacttaggtctggaaactgggttcgaggctgtaacaccactggggcagtacaagtcaggaattgcggcggagtgccgtggctcacgcctgtgatctcagcactttgaggggcggaggtgggcggatcacttgagcccaggaatttgagacctggacaacatggcgaaaaaccgcctctacaaaaattaaaaactaaaaattggctgggcgcagtggctcacgcctgtaattccagcactttgggaggccgaggcgggcggatcatgaggtcagcagatcgagaccagcctggccaacatggtgaaaccccgtctctactaaaaatacaaaaattagctgggcatgctggctggtgcctgtaatcccagctgcttcggaggctgaggcaggagaatcgcttgaacccgggaggcggaggttgcagtgagccgagaccacgccattgcactccagcctgggtgacagagcgagactccgtctcagaaaaaaaaaaaaaaaaaaaaaaatatatatatatatatatatttaaaaattagccaggcgtggcggcacactctaatcccagctgaggtgggaggatcgcttgagctcaggacgcagagattgcagtgagctgagatcacaccactgtactccagcctgggcgacagagcaagactgtctcaaaaaaattcgtgtatggccgggcgctgtggctcacgcctgtaatccgagcgctttgggaggccgaggcgggcggattacctgaggtcaggagttcaaggccaacctggccaacatggtgaaaccctgtctactaaaaatacaaaaatgagccgggtgtggtggcacacacctgtaatactagctacttgggaggctgaggcaggagaattgcttgagcccggaagacagaggttgcagtgagccgagatcatgccactgcactccagcctagtctacagagagaaactatctcagaaaaaaaaaaaaaaatctgcctacagggcgggtgcagtggctcacgcctataatcccagcactttgggaggctgaggtgggtggatcaattgaggtcaggagttggagaccagcctggccaacagggtgaaaccacgtctctactaaaaatataaaaaaattagctgggcatggtggcgcatgcctgtaatctcagctactcgggaggctgaggcaggagaatctggcttgaacctgggaggtggaggtttgagtgagccaagatcacaccactgcactccagcctgggaccacagagcaagactcatctgtctcagaaaaaaaagaaaaaagaaattgcacctacagtctcctcactctctagtgggcgttaaaatgagctttctgtagccagtttgggcagacggaggatacagcctaatcctgggtgccctagtaggtcgtgcaggctgttctctgcacaaggacatcttcctggggagcgagagggctgaaatccctcccgtgtcctcgcctccagccgagtacctgccccgagagcagagtgcctcttgctgatccgcacataagcctgcaggggtgggtgggggccctggagcccagacaggcaccaaggaatcttgcagccctacaaggtgaggacgggggaactgtcggagttccacctgttggctcctctccctcctgaccttcccacgggaatccttccaactgttggctcaaagaaattgaagtgggtttctccattgctaccctcgccatctaggactccactgtctttttttttttttttttttttttctgagatggagtttcgctcttgttgcccaggctggagtgccatggcacgatctcagctcagtgcaacctctgcctcccgggttcaagcaattctcctgcctcagcctcccgagtagctgggatcacaggcatgtgccaccatgcctggcttattttgtatttttagtagagacagggtttctccgtgtggtcaggctggtctcaaactcctgacctcaggtgatctgcccgcctcagcctcccaatgtgctggaattacaggtgtgagccaccacgcccggcttttttttttttttaattgagacagggtcttgctccgttgcccagactggaatgcagtggcatgatcaacactcactgcagcctcgaactcctgggctccagagatgctcctgcctcagcctcccaatcggctgggactacaggcacacgccaccatgcctggataattttttttttcttttgtagagatggggccttattaggttgcccagactggtcttgaactgctggagccaagtgatcctcctgccctaaccctaacccaaagtgcggggattacaggcaggagccaacgtgcttggccagactccatggtctcttacctggaccaggacgatggccccacccaggccctcagaactgtgggatgaggtgtttgcttctggctcacccacgagaaagaaactcccggaaggaagggaccgtgtctggagcgctccaactccaggccccagactgcaggtatcccttgccaacagagctgaggccagcaggggaaaccattcctgccacctggactaagaatgagatcctcttgaaaaaaacaatattaagaagtgggctcttcccatcacgccaccagagtcccaggaagccagggatgtgggtgtctaatggtccgggacaagatgatgggaaacttcacatggagaagaaaatgcccaagaatgactgaaactgtctgcaaggtcctgctaagggagctggcaggtgcaccaggtatggcgagatgcaaagcaaggagcccactgcatcgttccctggaaggacaagtgcagaggagaccacagatgcctgcgcatttagcgggagtatggcagtgccatcatgggggaaaggctgtgtgacaaatggtatggaggagactgactgtcccttagaaaatgggaaaggagccaggcgcggtggctcacgcctgtcatcccagcactgtgggaggccgaggcggggggatcacttgaggtccggagttcaagaccagcctggccaacacggtgaaaccccgtctctactaaaaatgcaaaaactagccaggcatgctggcgtgcgcctttagtcccagctactcggtaggctgagatgggagaattgcttaaacccaggaggtgaatgttgcagtgagccgagatcgcgccactacactccagcctgggtgacagagtgagactctttcaaaaaaaaaaaaaaaaaaagaacagaacaaacataagaaaatgaaacatcagtgttcttgaacccagcaatcctaccccttgataacctcagcaagagcaattctcccttctcgctaaggccacattccgtgccatggccttcgtggcatggtttgtggcacaccaggagctgaagccctggggttgcatcactcagggtgggaatgatcaaatgtgttgcatccaagctctgaaatcctctgcaggagcacaggagtcaactgtacgtctccagggccacagacaaagagctgagaaaccctgttgaatgacggaagcagtcagcagaataggaatgcagcacagggacagttacggtgggcaaaaccatacacacaaaaaatccacaggtgcagggcagtggctcacgcctgtcatccaagcactttgggaggccgagacgggcagatcgcttgaagccagaaataggagaccaacctgggcaacagggtgagacctcgtctctacaaaaaaataaaattagctggcgtggtggcacatgcctgtagtcctagttactccagaagctgaggtgggaggatcacttgagtctgggacatcaaggctgccgtgagctatgatcacaccactgcactccagcctgggtgacaaagcgaggccctgtctcagaaaactaaaatacaattgaacaaacacattccaaatgacaccacattttaaatgacccctttgggagggaggggaacaggactaggaaacagggaagaaggaaaaagcgaaaagctacagttctcccatctaattttcagctacctaaaaagctgttagcccaaaaggtgctggtgaggctgtgggtaaacgctgagggtacaatgcgagggacggacagtatcaaaggtagggtctttaggggaggcaattccctagtgtctcttacaattttaaatgcaggccacacaaggtgggacacatctgtaaaaccagcactttgagaggccaaggagggaggacttgagcccaggggttcaagaccagcctgggcaacacagtgagaccctgtctgtacaaaaagaagttttctaaaaaagccagggatggtggcacacacttgtggtcccagcagctcaggaggctgaaacaggaagatcacttgagcccaggaggttgaggcggtggtgagctgtgatcgagccactccactccagcctgagcgacagactgagatcctgtctcaaaaaaaaaaaaaaattttttttttaatgtacatatatctcgacccagcaattccacttacaggtaattattctagagagagatggatgcacgttcaaggctgtgttcatagtaaatgcaaggtagaaataataatgctttaaaagtacatcaaatggaggcccggtgcagtggcacatgcctgtaatcccaggtactcgggaggctgaggcaggagaatcacttgagcccaggaggtggaggttgtggtgagctgagatcacgccattgcactccagcctgggcaacatgagtgaaactctctgtctcaaaaaaagaaaaaaaaaagtttaaagtacatcaggccgggcgcggtggctcatgcctgtaatcccagcactttgggaggccgaggctggtgcatcactgaggtcaggaatttgagaccagcctgaccaacccaggtgagaggtgagaggatcccttcagcctgggaggcaaaggttgcaatgagccgagatggtgccattgcactcagcctgggcgacaagagtgagactctatctcaaaaacaaaaaagttgaaattataaaaaagctaaaacaaacaaaacaaaatcactacaaaacgtgtagcataacggtttttttttgtttttgtttttcagacggagtctcactgtgtcacccaggctggagtgcagtggtgcgatctcggcttgctgcaaccttcacctcccgggttcaagcgattcttctgcctcagcctcccgagtagctgggactacaggcacacgccaccacgcccagctaatttttgtatttttagtagaaacgaggtttcaccatattagccaggctggtctcgaactcctgacctcgtgatccacgcgcctcagcctcccaaagtgctgggattacaggcgtgagccaccgcgcccggccgcataatgggtcttaacttggctaattatgtgggtgattgcacagaaaaatagtataaataacttcatgcttttttatacatgggataacttgcttcaagttgtttcaaaaacgtttttttttttttttttttgagacagaatcttgctctgtcacccaggctggagtgccgtggtgcgatctcggctcagtgcaacctctgcctcctgggttcaagcgattctcctgcctcagcctcctgagtagttgggattataggcgagggcgccaccacgcccggctaattttatatttttattagagacagagtttcactatgttggtcaggctggtctcaaactcctgacctcaaacgatccacccgcctcggcctcccgaagtgctgggatcacaggcgtgagccaccgcgcccggcctcaaacacctctcaatgattcgcttgagtatgtgtaaagtgatgcacaggccaccctgaagaccttggtggtttctattgaaactacacatcaagccgggcgcggcggccggtgcgcggtgcccagaatcccagcactttgtgaggctggggtggatcacctgagcccaggaatcccagaccaacctgggcgaaaaagcgagaccccatctctacaaaaagtaaaaaattagccggacatggtggtggcgtgcgcctgtagtcccagctacacggaaggctgaggctggaggttgaagccctcgctggggtggagaggtcaaggctgtagtgagccctcatcgcgccactgcactccagactgggcgcagagtgagaccctgactcaaaaagaaagaaaaggaaagaaagaaggaaagaaaggaagaaagaaagagaattacaaataaagctacacatccacttctacacttctgcgtggactcgagcgttcaagatgggcgtggcaacccgatgacaggaaaccctacacgggcgtgctcccagcaggctcctccgtgagggccaccagccacgggaaaccacgaccttgtccctcaccagcaaaagctcagcctgcggctccgcgagcgtggaccgttccgtggccatgagcgggaagaaccacgggcccccgccaggggctgggatggatctcgcgggcgggaggcggagggtactcggcccaccccagcggaggacaccgcgtgggtccgctgagataacgctccgcggtgatggactccatgactcccggagcagagccctggctgcgctgcaccgcgggagggaggggctgcgtctactgcggggccacgagagggaggggccggggccggggccggggccggggccggggccggggccggggccggggccggggcgggacaggaacccgcgcaagcgcggaaatgcccacggccgcgccctcccgcgcgcaccgcggcgacacccgggccgccctcggaaggcacggacgtcgcgccgcgctcccggggcgcttcacttgcgcccacggccgacgccccggcagcggcgggcaggtgccacgacctctggacgtttctcgccccttctcgggaatggaacgcttagagaagcgcaggtccacacccaaaacacaaggcggcactgttgcgtgtgcaccggcgactctgcggccagcgccctgggtctcgccccgggaacgcctaggagcctgagagcgccgcgccacacccggcagggccgcagcggcgcgcacgcgacggggtgtcgtccactgggcagcaggagcgtcagtcaagggcgaggggcgggaattccgtgcaatctgagcatggtcattggcgaggacaggcgaagaggaggacggataggcggggctgggcggggcttcccgtgggcgcctggagcttaccgggagcgaccgaagcggaggcggggagcgaggcagctgtgggccccggcgggcggagactagggctgtccctccacgccccgcccccgcctcggcaccgccttccgcgcctgcgagtcctgggccggccctgcggggcatgcgccgagtccccttcctttgcagaccggtggtcactgtcttcccccggggacgaggcggacaggcgtcgcctgagatcagggcccgggaagccccgtgagccgctctcgcctcggcgccgtcgaggggccgccccgcccttcccactccactgtgctgcgaaagtgcctcggggcgcgtctggggggtcgtggggaagcagggccgcgcccacccggcagcgtccagggagaggtgggcagagcggggcgggcggccgtcttgggggaagtggcgtctggaggtgtctgtgcaccattccgcggtggcgcgcggtggggtaacaaagtcttccccgtcccttgacagcggcggccgccggggagggaatcctgctctgctgcgggcggtcgtgggctggggcgcttcctggcctgactgtctcctgggggaggtaggaaaggcgagccccgcagagaaggcggtggcttccctcgacgtgggtgccaacaggagccatccctccagccggtcttcccgcgggagggtgcctgggaacacccgcagggctggttccagcacccatgggaccgctgggtccagcccagtgtttccggggaagccccgccttacccgccaaccttcccgcaccgggagggttcccagctgctggtgatgctgctcaggcgactccccgcagcgccaccacccacccccccgggagccggccgctgggtttggcccgtccgccctggttcctctttgctgggctctgaggcccggcgggacttctccgcggcggctctggcgacccagcatctctttgccctggggtcagacgggctcccaaggaattgcatcccggtggagaagacgcttccttccctctcccttcctctcctccgcccccttttgctctcttgtccttgcactttgccttgtccgtgtgtccggctctgtgtgtgtgtgactgacgcgagcccttagtcacctcttgctactattttctccccttattatcacttgtctcttgactgtgtggtttgcgggttgtgcttggtcacagaggggattttagttttcgtgtcatcagaatctccaggctttcctgatggcttctgggggttcttgtcggtttgtttccttctggctcacgccgtgtcttgccccctggacgctgggcaccagttccgactactgggtaacagacgacttcacgtttcggtccttccccacctagcactcgtctcacccccccagcactcgtgtcacccccccaagggttctgagggacaggctctgggagggctctcggggagccaggactgtggctcagggtccctctcaggctgcggtcaggtgtccactggggcccagccatcctatctgactgggtggggagccctcgtgatgactctccctctggaggctgtggcaggaggcctcagttcctccccaccgggcctcctccccagggctgctgggcttcccccggacctgcaatccagtcgaaccagcaggagagggcgccccagacccggccacagtctcttcatggcctggtctcctaagtgactcgcctcgcctccgctgtggtttttattggtctcacaggtccaccctggcgcgtgctggagagggcgccacgctcagggtggaggctgttcctgagtgctgcgagtcagaagcacccttgcacgtgtagacctgcgtcggctgctggagatcccgagcgggccgcctcaggaacatgtccttggtgtcagcgggagcagcaggccacctcctggggctgacactggccggggcctgcatttctgagggcggggcgtgctttgacatcctgaaagggttgcaaaacccatcacagagaaccccaagaagggagactctgccaccgagaccccgtgtgccccgcagggtctgcgccgtgtgctctctggctcttcatggaagcctttcccagccctggtcggggagccccggtccaacatccccaggagccggtgggaagcccgttctggtctgcatggcatgagtgccccacgccagcccgggtggcaggatgtgccccccacctccaatgcccccctcccaggggctcattcctgcccctgtcccctctctgccccaggtggggcagcctctctctgcagacaggggaggcctctcctccccgcatgcagccctgaaggggaggggccggggcagggagggggtgtgccgcgtcgtcatggtgaaggcagagcagctccttttctccgtgatgtgtcaggttgccggatactgggctcccgtccctggcctggagggtgggatgtggagggccaggtgggtcctggaaggagctttccactggggccccaggaagaccttggtgtctcgtttccctggagacgtgccccatccttcccactgggactggcaagtgacttgctgatgacgctctccgtggctctgagtttgtcacagaggttccgtgggcggtgagtgcttttcctgttggcccgcgccgcctctgggcaatgcgggggcccttggtgacagctcctggccccttccaaagccgcctggcccttcttgaacccgacgagagcaggttgccgggccttccctgaggaatgtgttcctggcaagtggggacagcccctcccccagggtgtcgggtacagggtcctggggtgcttcaggacacggtcaggcccaccgaccccccacactcctgggccacctgcctgctggctgtcctctgtgaccctctctcccctgagccgaggtgccggcccgatcccgcgggaagaacagcgaggagggccggctctccctgctatgggggcctcgggggcctggacggggactgtgtcctccctccccgggctgcccggcgccctcgctcagggagtgctctcctagcgacctgttcggcagatgggcacagccacgacagcagccagaccctgtcccggcccatgcacccacctggacggatcggcgccctcctggacttactggctccattgagggtcccaaaggagctgccccagagcaccctaggggcgtccggacccctcggcccgcagcagctaccagcagcccaggcaggacccaggggcttccgggcacagaggcgccgctccctggctcgtgagcccagggcctctccagccgtcccctgttgggggcctccactcctgctctggatcaaggtcctgcccctagggagagctggtgccttcgggggagcgggccctggttgcagttggagagtgggtccagggatggtgttctgcttggctgccgccctgcctcctgggggcctccccagatcccccccggctgctgtcagctggggctgaggggtcctgtggcctagggggcatcctggttcgggagtgccctgccctggacaccgtgtccaggaaggatacatgctcaccctttgttgggggccaggcacagggtgagggggcactcggccccaccacccgtgtctctgggaaccctggctgggtacggcccctcttccgagagatcctgcccgggactggtgccgcctgcctcgggcctgccccccacacagttggggaccctggcggggcacctcctgccagccacctgctgctgtcctagcctcagccgggccctgcaagctgtccatgtgcctgggacacccggtccctctgcaaatgtttgcaaacacccctgcccccacaggcatgtctgggggcctctctgggcctttgtgtgccgagttgggcgtgggtggcggcgggggtctttccatagtcacctacttcctgtcctcctcggccccaggtccagcggtgccctgtctgctcggtttccagcctgagccctttcctgagctggcccggtcccctaagcttctgcagcaggttcccaggtccaccccgagggactcctggccagtgttcccaacagtgtctgagtgctggcctcagtccctggccatggattttggggaaccccgctctgaggggccgttgcttccctttcctctccaggtcccctcccagtttcctcggagagcggggatggggctgttgggaggcggaagggagggttggggtgcagaggtgtggcttgggggagggaaggtcaactgggctaccgcccctccctgccctccctggactcagtccagacacaacctgcgggttggaggcctgtgcaccctttatctcctcctagtagcctggcgggtcctcctgggtcttcctcagtgtgtgtgagtccccaggccataggacccggcagggtgggggcccgtgctctgctcttgtttttgctcctacttgcccgcccttcccggggggggccctggccaggaccgtgccagtctctttccctgctgcctgcctgcctgcctgggtggcctccagctcaccaccctgtgaggcctgtggcctcccgccagggctgtcctcaggggcccggatccccctagtttatcttctgcccttgccgccccacatgtgtccctccctgcagcctggggacgatcggcaggtttgggggaccggtgcccttggttcacctagcccagccctagggcggtggccctgccaggcatggggcttgagaggggatgtgatggagcagacacagggagggggcaggagaccctgggtgactcgggacaggagggagtgccccagaggttcagaatcctgggcacacagtgggctgagcggacaagtcgcagcctcagggggacctcccgtcctcccaactggcactgcatctttctgggcctggctctgctgcctcacagccccgttcagctggtggcttttagaggcttccagagtgtgcttggcccctttacctctatgccattgggcccagggggagcagtagagtggctgcggctgggggtgggacttcccctttctgtgtcttgcttgccccgtgtctcccagtgagtggccgccctgagcctggggccagcagcccagccccaggtggaagtcaggcagggttcctctgccgttttcctttcctttatgccatcagagtcaggagtgtgccatgctcatgaagccacaggtcctacacccctggcactctcttcttgaaagtggtagcagccccgcagacacccttcgtacctccaacccagctgagggtcaaggcaaatgtccttcttggccggtcttggcgctgtcacctcttttggacctgtctggggccaaggtcaagggccttgccaggaccatgggttctggaccctggccctgcagtccctctccacagtctccttctccactggctgcctcgacactctcccagccccctcaggtggttctcctccctggtctggcagggcctggtggtagcggaggaaaaaaatccagtatcttcttggacagtgcccagagtggcctctcgcttggaccttgggcagctgctgccccctgctgtatgtctgagcatggctggagccctgcggggggccccagattctttgggaactttggaaagtggggccacagtggtctctcagagctctggagaacatgtaagtggaggcctggaggctcttgaggcccatggaaccttcctaatcctctggttccggctggggcacccagtgcacttcggtgtgtccagaatagtcaggatccttcatggggttcgaagccctgggggttggacagatcacaggatggggttggcagaaccctgaggagccctgaaacggtggggggagtactccaaggcccatggagccctggggattggtgaccaagcccaagtgggaggcctcaggaatccagagggagctcagggaggtggtgggagcagagccctggggaacgccatgagccctcaggagcagggagtctcgcagcccttttcattccctggggaactggggtggggactccgggagccctcttccatccaatcttgggagctcttttggaatgaatgaaaaggggcaagctacgtcaggggtggccgctgttccttccttccctctcttccctcacgccagacaccacagtggttgccaagtacacccagctacctcctctttactccccacctggaacagatccaggacctgacctaaggcctagaaagcaccatttcgtcccgatatctggatatcttttccctccttgggatgccccaagcccagctccacatcccccatctccctgacaccagctattactccagagctttgggatgtcaaccttgccaccaccccaggtcccatgtaggttcctgctaggccccatctgcctctgtccagccacactgggctgcagtccagccccaatcccaggtagtgagtgcttcctgggggaactggactgaggtgagttcggttcttcctgtcagtgtacttggtttttatcagctgctgaaacaggaggctctgtcactgcgtccttctagggtcctggcagtagcaacctgtttgttctgccccccatgtacaggctcattaatgggaccattgaatccctaaggtggacctgtgaggaggtggcatcccctgcccatgcctaccacccgccatggaccatccaggtctcgcctgctgcagggccagccatcagtctttgcattgggcttgggatggtgaggggcagagggcaggggcttggggaatccacacagcaagtggctgggcactgcggggtgagccaggtaagaggagctcatagcaatgaaacaagaaaggctgaaactgtgagtggtaagaaaattagaagtgattcactcttttctgcatgtttgcaacacacaaggaccatgtactattttaggaccaaaaatatacgtgaggagagacgaggatgcagccaagataaatggtcaggagtagccagggagggtcccagccccagccctgcctccacaaatgcatgtgcaggcactacatgggagctgtgccaagtgtgggaggctgggctgtcccactacctgcagcaaggagccaaaggcttgggtgactaatgccagcaccccaccccttgctgggcctctgcttcccacctgcccgtgtgcagtggacggcagcccctctgtgctctcccgccctctgccagcagcatagagccaggcatgcacagcaacacgtggcattgtcttgggttttagtacccactttccacttaaaaacatatatgtagactgggcacggtggctcacacatgtaatcccagcactttgggaggccaaagtgggtggatcatgaggtcaggagatggagaccatcctggccaacatggtgaaaccctgtctctactaaaatacaaagcaatagccgtgcacggtggtgcacacctgtagtcccagctactcgggaggctgagggaggggaatcgcttggactcaggaggcagaggttgcgatgagctgagattgcgccactgcactccagcctggcgacagtgagactgcatctcaaaaaaataaataaatatataatatatatagtaaacttcggctgggcacggtggctcatacttgtaatcccagcactttgggaggccaagatgggtggatcacctgaggtcaggagtttgagaccagcctgaccaatacggtgaaacctcgtctctactaaaaatacaaaaattagccaggtatggtggtgcgcgactgtagtcccagctactagggaggctgagacagaagaattgcttgaacccggaggcagaggttgcagtgagccaagattgtgccattgcactccagcctgggtgacagagcatgactccgtctcaaaaaaaaaaattatatatatatatactttgaagattatgaaatacatacccagggcagaaaacctgggagctaagtgagaatataggcaggtgaattcaatcacccagggatgatggggcatttcagcctttggagcttttctcccatgttaaacaagcagcagttccaggagctgagaatgatgtgccagagacgcctcattttctttccatccccatgccattggacaccgaggtggacttcagctttttccagttaaaacacccgcagactgctggtagcgtgcatgcagctttgcctgaatttccaagtgggttctctgtatataccttgttgtaccacgattatatgtataagcagttacacgtgctttggggaatgagttagggaataaaactcccaaacaaaacacaaacatctctgggtaacatttgattcctatccccagactaaagcaaaaatgcggacccaacaaagccggattgcaatcctggagccccaagacgcagaggcccttgccatgggagcccaaccctctcctccaggaagagccaacgcattacaaataaacggggcttttattgtgtgtccacaaaaacaaagtcagggtggcctttggttaatcccctccccccaacaagatgacaaaaggaggaatgcatgtcaacaaaatgacaaagaggaccatggagggcctgagtctgctgcctccctggtgggacaaggcagggggagcaagcactactctgggctaggcccagcgccccccaagcaaaaacacataaagcccctgcccctgcccccacccccacccccactgctaaggcagtcagccaggacttccccaaagacctagctctgaagcccagaccctcatggctccctctagaaggggttgccttcttcagcctgcatgaagtggtaaatgaagaagaggacgatcacaaagaccaggaaaagcagcagctggccccagagcgggacctggcgatcctggcccagcccagccccaggagcacggttttcaggccggatggcacggcgggtgagccatgaagaggaagatgatgaggaggacataaaagaggtggaggaggaagtaggataataggacaggtccagggagctcctggaggctgaaacagggcggtagtgcgtgatgctctggtaggcactgtcccggccgtacatggggcgttccctgaggcaaaagaggggagcaagtgggccaggagcctggacccagaaccagcccgtccctgggctcccccactacgcacctatccttgcactcctcttcagaagaagacaaaagatcgtcatcatgcacctgcagaagagagtcagggcgaggggactggctggcagggccaccatggccctgtcatgtccctcagtccaaacttccccagccagtcccctctgacctttggttagaggccaggaacccacaccctcctgaatggctctgggtgttcagccctttatccatggggccttgccacttgtgctcatgccccagcatccccttttgcccccaggactctcaggaagagtctgagcctagatcccagaccagggtgctctagtcacacagagtctccccggaggcccaagagccaccatttgtacccagtgcccccctggatttatccaaacacagccgcgatcccctaggttgtacccaagtacaggacgcctgccagccagctcacctggtgatggaaagcgtcagcatctgggaatgaagtcactgactggcggacagccctggacgggccggcagactcgggctccccataagtcctggtggtgaagtagctctcttcatagtagtcgtcattgtagccttgggaaggggggcagcggtagcagagggggcatcggtgtgccccgcctggcctgatggccctaatctgaatcccatttcgggacctgtaacagtttctccctcctaaggctgctggagtggttgggactgaggtctcaggtcctccctgtgagcggggtccctgacgaagtcgggtgaaggtgccagcgtgcccacccaacccctgccttacccttgctctggtagagtaaagcgtcctctttcttgggaagatcatacatatctgcatcccctctagtcgaattcaagtctggattgaaaggaggagacagaactgtttgcccccccagacttccctcccctttctccagtgccgctctcgaccggcccccctgccacaccctcgcgaccccatcctccccgcgtcccaggctgtccccacaggcgaggctctcaccagagaagctataagaggaggcggcggacgagctggggggcgagagccgccgcctctgggtctcgtactcgaagatcttcttctcgtaaagcctacgagttgatcctggccggacacggggcggtcagggccgcgggccggggaaggcgcgcggggagggcagcggggaggtcgcgaggcggagcacgaggagggggcccggaaggggtcccgcccgccgccgcgtacctactacaggcccgtgcgggatgttgtaccggcgcagcaaggtggtcagctcggtatccgaaagatctgcgtagttgtccatggcgggtgcgggctcaggcggaggcctggcggcggcccgggcctaccaaaaccggccgagcaacggctgccgaggagcacggcgggggcggcacgagcgcatcgggagcggccgcgctcgcgtcacagccgaatcgttgtcgcgtcacagccgaatcgttgtcgcgtcacggccgctggctccgcaggctgcgcgcgctgcgcggggcgggacctaaccgcgggagcagccggcacagaccggccgtgccctgagagctgggaggctggggccgcgagcccaaacgtcatcaacgcgaggattggctagcggcggagagggcggggcccgcccgggagtcagggcggtgggaaccggtctcgcgatgggagcgggcggggccgcaagcccatatgtcacaagcacggggattggctagtgatggagggggcggggcccgcgcgggcgcggagcaaaaggtctcgcggtgggagcgagcggggccgcgagcccatacgtcacaaaacggggattggctagcgatggagggggaggggcccgcgcgggcgcggagcagaaggtctcgcggtgggagcgagcggtactgcgagcccggacgccactaatgcatggattggctagcggcgtagggggcggggcccgcgcgggagtcagggcaatgcaaaccggtatcgctgtgggagcaggcggggctgcgggcccaaaagtcacaaacgcacagattggctagcggcagggggcggggcccgcgcgggagtcagggcgatgcggctgggagcccagacgtcaccctgtggcgtgcggcggggtgagaggggcggggcctgcgcgcgagggacccgggacgtgcgagcgggcgaagtcggcgcttggggtggctctggtccctaagtcgcttgggcttcgcccgatccctgcacatccctactccccgccgtcgtcccccttcccagggccccagagcctagggttccccggccgcatcccggtcggccgccccagcagcggcgggaagggcccggaccctaagagagcgcgggccccgggccaggcgctgccgagggcgctttgtgtgcgcatcgcccgggaagcggctgcagggcaaggcccgcgcctacgcgatccccgcagaccccctgccatgggcccgccttcccagtctgcggggctctcgcccgcgcacatgtgcctgctgcttaccaccgcctacccctctgcttcccttcctcctccctcgctccacccgggaggaaatggggcactgggccaggaggccgctggcactccagaagcaagcagtcttcgaaggggcccgggcatgccgacgggcacgccagtgggcgcgggcagagggcgccgtgcgatgcgtgcagagacgacgtgtgcccgcctaacccttcatgccgttcattcacccggggcactggggggagctgaagtggggcgtcctctcctgtcggaatggtccctgagcgcagcgtggctaggcagggggcagacgtgggtggcgagctatggattcccattcccagggccttgatcagatattggctgtctcatggagaagagaaaggaggtgacattcatcattcatattcttttttttttttttttttttttgagacagtctcgctctgtcacccaggctggagtgcagtggtgcaatcttggctctctgtagcctccacctcccgggttcaagtgattctcctgtctcagcctcccgagtagctgggagtacagtcacatgccaccatgcctggctttgtatttttagtatttagtatttgtatttttagtagaaacaggatttcaccatgttggccaggctggtctcgaactcctgacctcaagtgatcagtccggctcggcctcccaaagtgctgggattacaggcataagccaccgcgcctggctgtgacattcacattctaaacaaagccagctgagggtgtatggaatcaactagtgtgcccctcactgggtaggccccaaactgggagcatgaagaggtgacatgccatctgtagtttcacagttgagggctggtgacaagggaagaagaggggagggctctggtcatgtccagaatggctggcctggctggtgagggtcacagaccagtcatccatggaggtttgcccatggggtgggaagaggtagacacctgggggagtaatgaggagatggggccctgttttgactacacgcaaagatcctaacaaagaggaatcactgttggcaaggccccactgtgtccccagcaatatggaaggaagtgtgggtccatgaagacagtgcctggcagtgtgcagcaggagagccttgggtagggcaggggtttgcacctcatctttcagagctgaggggacagatggcagtttggactctgggctgctcagaggctgccttgtggattttttagttttgacaaaatcagattccccagcacctctgcaagccttctgcaatcctggcccctctcccagaggcctctgtgtactaagtgctgctccatcctcccccatgccacccctccccatacggatccaagctgtttccttatgaggtcaaggaattctagatttgccttctccctaaggagcaccccccacccgttctgtacctgcctcgacactctgccttttatgtcccacccctttgccccacaatcaggtcccaccacagatggcaccaggaagctgaactgtgatggtccccctgcacccaccctgtgggtacctggagcctaagtccagccccattgcagtgcagctccactctagaccactggaagccaggcaggctcctgagcagcagagcctccatcttatacagggagagtcaggaccctgcgatcaggggagacttgtccaagagccctgagtacagcaattaattcatggaacattcccccaccagtacctggtccctgggggtgatgacctggacagcctcagagagtttcccgtcaagggtagggtgggatttgcagtcatcagagggtctgggaagggcgtgtgcaggaaaatctgagggcctcagggggttcttcctgggaagtgcaggcagaggagacatcgggatgcaaccaattctaagtcaagaataagaaaactgagttgctccttaaggatggaatggcttgcaagcagtatatgctgtataacttacaatcccaacatgattgagttacgaggaaaaaatatcaacatggaaacattcctcagtgtctatgacaagtagatgattgttcactgagctgttaacgttatttttttatttgtatttttatttttatatttattatttttttccaagacacagtctagctctatcacccaggctggagtgcagtggcgcaatctcagctcactgcaacctccgcctcccaggttcacgcgattctcctgtctcagcctcccgagtagctgggattacaggcgcctgccaccacgcccagctaatttttgtatttttagtagagaccgggtttcactgtgttgaccaggctggtctcaaactcctgacctcgtgatccacctgcctcagcctcccaaagtgctgggatccaccacgcccggcctttttttttttttttttttgagacggagtctctatcacccaggttggagtgcagtgacgtgatctcggctcactgcaacctctgccgcccgggttcacgcgattttcccgcctcagcctcccgagtagctgggattacaggcgcctgccactgcgcccggctagtttttatatttttagtagagacggggtttcaccatcttggccaggctgttcttgaactcctgacctcgtgatccacccacttcggcctcccaaagtgctgggattacaggcatgaaccaccgcacctggcctttttttttatgtttagtgacagggtttcactgtgtgacccaggctggagtgtagtggtgaaattatagctcactgcagcctcaaactcccgggcttaaacgatcctcccatctgtctcctgagcagctgagactaccggtgcacgtcaccacgcccagctaatttttatatttttggtagagatagtgtcttgctgtgttgcccaggttggtctcaaactcccgggctcaattaatccacctgcctcagcttcccacagtgctaggattataggcatgagccaccatgcccggccaatgttttctttaagatcagaatcttcttaatactaaacaaacttaactttctcgtccccctgagcgatcctgtttctgctgcccaccccaggccagacctggcagcgcctgatccatggcagtcaggttcatcccagggctcggagccctgcagtcccgtcccggggccctgcctgacgtaggcgcccagccaacacctgcaacgacctgttgcccccaccccaggaaacaatcccggcttgggacagacaccaggggctgtgactgtgggtggctccttggagaaggtggccttgggcctcggcctttccacctggggtgcgcttggctcccccagactcagacacgcaggatccttgtgattgggcctagacacgagccctgcagtccctgtgggcgctggaggcgactcccccacgaagccctccctcccccagggcctggcggccctcgccggcggtgagctcatctcggggggcggcgtcgcccggcggcgggtcgctggagctcacggcgtgcccccgcacccccgccccccacgcacccgtcccgggctcctgggcaattttaccaattaaggctttctcgccgggccgggccgggcgcggggcgggcgcggggcgggggtgcggccaacaagaaggcgggcggcggcggcccattcgcgtggaggcgcgtcgcgcgcagcggacgccgacagaatccccgaggcgcctggcgcgggcgcgggcgcgaaggcgatccgggcgccaccccgcggtcatcggtcaccggtcgctctcaggaacagcaggtgaggtctccgcggcccggcttcgcgccgtagggtcgccgcgctcctcgtcggccgggggcggggttggagaaggcgggcagagaggccggaaaacgcaggcgccagctcgcgcccaggtccgggccaggttcagctgggatgcgtgagccgatggaggctcccctggcatctgggagtgagtgtccagagaatagcttccctagttgacccacgagccatgtctgtgcccacgaatgtgggagcctgaggccatggggggtccccgagagagagagggtgtctgggcacttgcccatgaacggaccactgcatgcctgagagagaagggccctgacaccaggaacttgtgtggactcagggcgagtggccacctggaaggacacttctcagccagtgtgcccactgggagggggacagcgtgtcccttgctggctcgagtccacagggcaccagctgctttgggcacaggggagctggttctggggctgctctactccatgggggccatggtgaggatgagaccaggccaggttccttggttgggccctgggccctatgccaggttggctctgagttggatgcgcactgccagccaggatataaccaacaatgtccccagattcccgtgccacctggggccaggcaaaataggttaaaatccactggcagacccatttgtaagtgctccgagtgcaccgtcaaggtgggagcttgggaatgggcgacctcacctgccgcacctggacttgccagcacaggtctcttctcaccttgccagtctgcggcttccttccctcctgcgccccctggctacgcaggcctggaaacagctccttagggatcccagctgaacagctcctgggcttgggctatacctcccagtgggagggtctggcctggggtctgagggccaggggtggtgtggtgggcggggtgtgcctaacatccaagaatctactccaaataagggaaaatatgaaagagctggattttggcttcccaggactgcccgatctggtggctttgggatcgggcgacatctggcggttgatactatgttctagggacaagaaccctctacacgcccattccttgtttcctctaaatagggaaaagctagggctggaagacacggcacccacctcctgacactctttctgctggaattgaccactggtcactctgactcagtttccctgagctctgaagattaaggaatgaacccagacaacccagctcaatggcccttagtggagagagagtcaattattgatggaattccgtgcctgggaacttgctttccagtggggcagggggaccagaaggacaacttcaagcccgtcttgaatggggcccgtgcagggaggggtctgtatgggttcccccttcccagccctccctcccacctccaccccagctcccagacgcccaggcgcacttggtgcaggtgtgtctcaaagtggtcaggagaggggacaatatacaggggttggcctcagtactggaaaatgccatttgcaccccctaacaccactactagtgggaaaaaccagtggggccacaggctgccccgaagtgaatgtgctgggcggatcacagccccaccacgtgtcatgtagacacccagggctacaggagagtcaaccatatttgggcatgacgtgctggccaacccagggcctccatctctcactggtctttagcagataaattaattattactagaattgaacaggagggacagatacctgccttcctagaaaaaaaaaaaaaacactcagaggaggaaacattctggagaggggaggtaccgaggactgagagggaggggagtgcacaatggggaggaagccataggcaggctggcttctgactgaagatagtagcagtgagcgtccccagccgtcccctggtcccagtctacatctcggcacagcagccactgcaccatctccagagttatctaccagaaaattttgagtgaagagcccccacagctctggggacacaaccccccaggcccctgatccctgtcctcaggcctcctctgcacctgccaccacacctgaagcccacccagacccaggtgctcagagcctgacaagtcttatgggaacctctgagcaggcccctctgggtctggaatgccactcccgtgtttgccccctgccctggccacgctgggctgaggggactttccgacaggagaggaccccccgcttcagctccccccagtgccccgggtgaactggcatgaagggttaggcgggcacacgtctctgcatgcatcgcacggcgccctctgcccgcgcccactggcgtgcccgtgggcatgcccggaccccttcgaaggctgcttgctcctggagtgccggcggcctcctggcccagtgccccatatcctcccgggtggagggaagcagagagggaggcggtgggaagcagcgggcacaggtgcgcgggcgagggccctacggactgggaaggcgggcccgtggcagggggtctgcggggaccgcgtaggcgcaggccttgccctgcagccgcttcccaggtgatgagcacacaaagcgccctcggcagtgcctggtccggggctgccgctctccaggggttcgctcttagggttggccccttcccgccgctgccgggccggcggacggggatgccgccggggaaccctaggccctgggggcccggggaagggggatgacggcggggggtagggatgtgcagggacggggcagagcccaagtgacttagggaagagagccaccccaccccccgcaggggccctggggaaggaaagtcccttgtaaggcgcgccggctgcaggccaagcagtcccgcgccagacactgctcagcctttcctcgctctagggcgcgtttcctgcagcgccaacgcgaggctgcggggctgggagcatccttgcccaccccactgcccagcgacccaccctggagcccgggtttcgcgtctgatcagccgaacccgggggcctagtgggggcattccaacgggcggggcggggtggggcaggcgcgccctcgaagccccaccccacggcccctccccgcaggaggcccgccctctggccccgccctcctcccgcatttaaagggctcgctctctccgcagcgcaacctctgctccctgcctcgcctcccgcgcgcctaggtgcctgcgactttaattaaagggccgtcccctcgccgaggctgcagcaccgcccccccggcttctcgcgcctcaaaatgagtagctcccactctcgggcgggccagagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcggtgagggacgccccgaagcgccgggcgggcgggggcggggactccgtgcgtccttccatctccccgggcggacccctccaaaccacccccttccgggccgcagcgcaactcccgaggcctccggctgctctgctccacgcgggcctgcagaacaaaggcgcgcgggctggctggctggccggccgggcgtgcgaaccgctacgcgcccccgcccgctgcgccccggctggccggcgcccaggctgaactcacatcctccgcaggccgcgcctccgcggctgtgctcgcggtgggagtgggcctggggggtcgggcactgggcaggctcctggccctgcgccccgtccccgaggaggaggaggcccgggctctccccccacagctgtttagagagggccctctggccttcagaggcccgttggttctgaagtgtgggttggagctcgtgcgtcccattgtctggggctctgggctctttgtgtccctggaggatgggtcgcccatcggagatggctccaaccaccagtttagatctacccccccacacacacacaggcaacctgggggccagaaagaagcatagttagcaaaactgcacccggggtgagttgggcgtggttgactgagagacctggcttgtagactacttggacgccaacttttctcttcatcttgggccaaactcttgcttccatgtaggccttgcttttctgcgtgtagcacgcaggagttggttggtagatgctccagcgtgcattgtgccagcccagtgtctgtgtcactggactggagaggctggcattgaccaggcctgctgcagcagcccaattcgttctcaagataggggctgcatgagagggcaggccccagaatgggtgactcgggggtgatgtggaacagggagaggagagggatgatgagtcttctcttcttcagaattgagaggccttccagttaccctgcagccctggaatggcccttgctgaacccaagaaagtgagggaccaagacttgggttcccccagccactcagagggcagatcccaagaaccaaagttctttctttggaatgccagttgaggcgaggggcaggcccacccccacaagtcccagcctcagtctagccaagctgagtcatctcagtcctggatggtagggggggcgaccggatgtggggaggcgggccacaccccagctctttagggggggtctcctccctcctcccagctcccctcctccttgtgagctggctggagcaggcctagttcccagagctttgccatataaggcaaaaaaatgttggaaagcagcagtgattaggggagggaggggttggctggcccaggggctggggaaaggggggtgggatggggcggggccatccagccagacagtctcccagccctgggccctggtccttccctctctcttttgggagggggatggggacggagtaggctggcctaacatggacctggtgggcctggttgctccccgtgtgggggtcgttgaggggtctgaggctggactggggtgggggcctgatgggaagccctggctggccttgttccctggccctgcacccttggtcctctccgagtccccctccctgctgccatttggggagagtgaaaggcagcctcgtggggccaggaccaacctgggaactggggaggccactctgagcggctcacctggccctccaggtgctgcctgctgggctgggaagcagctgccatggacagcccagcccctcctcataggcccgccccctagttgactcaccagagaagtattttgtctgattatgggggaggctgacagggcttctaaagatgagccatcctgccttgagcctgagacccagaagtagccttgggtggggcccagagcccagcagggttgccatggtgatggggggtgtcagggacccgccctaaccacttcccctgtggcgagcctgccgaggcccagaggcccgttaggtggcaagtgggtcaggcagtgggtggcaagggggttcccagtgtctcctgctgccaccccggcatctcccgatgggccccagtgagtcagggccatgtggcccaactgctggttcctttgggctctgggcccctcccctggctaggcctgtggcctcccaactccaagcttgagtcttcgaggtggtagaggaagtgggggtggtggcgggggtcacaatccctcacccaaagggcgtttgcccaactcccccacttcccctgcctcaccccacccaccctggaacaacagttgtatttcccaaccacccagggccacccaccttcctcttcctcagccccagccccactccaggtcatgggccctggattctgggccagctggagtcagcctcctcctcctggttccccataggcccctgaggtgtgtggcggacccctgctctggcagctgtggacactgtccagctgttctccagagctgcccatctgcaggctgggtctgccctctgcccttcctctgggcccagggcttctggcagtaatcataccctgctggcatcgtgtgtgtgtgtctgtgtgtatctgccctcaccccaaagtctccttcacctctgaacaccccctgggaccctgggcagagagggcctcatccacatcctaccactggccaagagggggtgtctacctcctccttggcccctgctaccccgtgctgccagaccctgaccccaaagcctgggatcggcccctcccgcacagccgtgtgcccagcgtggccactcttctactcacagacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggtgagggggcgcagaggcaggagagactgggctggggtcacccatgggtggcccttgagggggttctgcggcccccagactcacagcctcccttgcgccacaggcctgtgtcctgactgggactcttgggacgccagcaagcccgttaccaatgcgcgagaggccatgcagcaggcggatgactggctgggcatcccccaggtacacccgcccggcctggctacagctgtaggggaccggatcggcagttgggagagactcggaggcccgatggctcctgttttctgcctgtgacaggtgatcacccccgaggagattgtggaccccaacgtggacgagcactctgtcatgacctacctgtcccagttccccaaggccaagctgaagccaggggctcccttgcggcccaaactgaacccgaagaaagcccgtgcctacgggccaggtgagggagccccaccaggggtgcacccgtgtgccaacgtcttccccataagacagtgtcccatctaaacgtggcggtccccaggggtcttgggttacatggcggctaggtgatcaagccacccaagagtcagacaagagtgggtttttgggactagtgaaaacgacaagagaatgctaataggttcctccagtcacagaagcctgctgcgtggggtcctcggggaggtagcatccagcggtctttattataaatggagatgaaccaggtctcagtaacagggacctaaaacccagtcaaggctcacacaggaacaagggcccagtgcggtgagaatgaatgttccagaaaacaggctgggcctgtcccagcagcgagagcacagctgggtcccgaggccaggctctgtgccacagctcacactgaatgaacttgcccagtttggaatgtgcctgacttaggggccagcagggagggctgaagggtggaggggtgaggctgtggccttaacagctggcccgtggttggctcgccttcccctgccaggcatcgagcccacaggcaacatggtgaagaagcgggcagagttcactgtggagaccagaagtgctggccagggagaggtgctggtgtacgtggaggacccggccggacaccaggaggaggtagggccagctgctggcagcagaggccccgcagcgctccctttcagtggggctgctcttagcaaaggctcacaggctccttcccactgcaggcaaaagtgaccgccaataacgacaagaaccgcaccttctccgtctggtacgtccccgaggtgacggggactcataaggtgagcccttggccaggggggaggcttgtgacctcaggcagtggctggaggcccccagccctaccctcacggcccacccttctggggacaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggtgaggggaggctgccaaggcccagctggtctgtggggagagccgcactggggcctgggagctgagcaggtgcctcgtggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaaggtaggcccggccctgactgccctctgctgtggcactgcagtctgggcctcccacaggagggggaccccctgggccagtcccgctgcagcccgccccggggcccctactctttgagcttctactgtctgggcacatgctgtttttcctcccctgctggggcccttcctcctctcctctcctcgcccctctccatctctctcctcacgctttcaccttcggaagagctcgctccagctgtctagaaacctgctgctctctgctctgcccacagggtcaacggtacttggatctgtcttcttcttggaagggggaggctggggggctctgggctggtgtggagcaggtgggaggaggcctgccatgtcctggcccaggccacagttcctggggtcacagtcccttccagttctgtcttgcatgtccccctccagccaagctctgagggacccaccaatcctgacagcccggccctgtgggaggcaagggaggggtcgcccagccgagctgctggtgctcagctggcccctctgcctgcagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccagtaagttggcctggagccaggccaggatgggtggcggcagcccccgggttcactgctgggcaggcctgaggccctccttgtcttggcagagggagaggagcgcgtgaagcagaaggacctgggggatggcgtgtatggcttcgagtattaccccatggtccctggaacctatatcgtcaccatcacgtggggtggtcagaacatcgggcgcaggtgaggcccccaggcatccctctcccagctctgcacactctgcctcttctcttccttctgcctccccacctgatgatgaggggccacatgggctcttcctgcctggccgccacagtggggcccacgctggctcatgtggtgatcctcggtgttccctgtgtggctctcgcatttgcagtcccttcgaagtgaaggtgggcaccgagtgtggcaatcagaaggtacgggcctggggccctgggctggagggcggcgtcgttggcaagtcagcagactttgtggtggaggctatcggggacgacgtgggcacgctgggtaagttggaggctgcagcatgggcacctggggacagacgatggcaaggacggcccaccctgaggctccagggcactgaggggactggtggctgttgtcaggcttctcggtggaagggccatcgcaggctaagatcgaatgtgacgacaagggcgacggctcctgtgatgtgcgctactggccgcaggaggctggcgagtatgccgttcacgtgctgtgcaacagcgaagacatccgcctcagccccttcatggctgacatccgtgacgcgccccaggacttccacccagacagggtaaagagcaggctgtgatggcctaagtctcgccctgctgctcctgcttggggtctggtggggatggcactctgtgtccctggccaccctgcctgggttgtagctctggcagcctggacctggccccctgacagctgggtggtctcccgctaggtgaaggcacgtgggcctggattggagaagacaggtgtggccgtcaacaagccagcagagttcacagtggatgccaagcacggtggcaaggccccacttcgggtccaagtccaggtagagcacccacgggtgttgggggcagggcaggtgtgggcacccaggcctgggcactgaccagcaggccacctgctcctatctgcctgacaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgagccaacctccaccggcctttagtccatctcgatagcattcacgtagcacacgattcgtccatttcaagtggttgtggcacaccatcctgactcccctgtcccacagctcctggtgaccactaacctgctttctgctgtggctttgcctatcctggacatgttctatagatggaactgtgtgccatgtggccttttgtgtctggcttctttcgctcaccacgaagttttccgtgttttcgttcatgtttggcatgtcttggcactttgttcctttataattattttgtttatttatttatttatttgagatggagtctcacactgtcgcccaggctggagtgcaatggcgcgatctcggctcactgcaggctctttctcccaggttcacaccattgtcttgcctcagcctcccgggtagctgggactacaggcgcccgccacccccccggctaattttttgtatttttagtagagacaaggtttcactgtgttagccaggatggtgtcgatctcctgaccttgtgatctgcccacctcggcctcccaaagtgctgggatgacaggcatgagccaccgcgcccatcctggttttttttttttgagccggagttttgctcttattgccaggctggagtgcaatgacgtgatctcagctcactgcaacctctgcctgccagattcaagcaattctctcctgcctcagcctcctgagtagctgggattgcaggcatacgccaccattcccagctaattttgtatttttagtagagacggggtttctccatgttggtcagactggtctcaaccgcctgaccccaggtggtccgcccaccttggccttccaaagtgctgggattacaggcatgagccaccacgtccggccgcttcatttatttttatggccgcataatactccattgtgtggccagaccacattccatttttccgttcacttgctaacagatattgaggatgagcttgcctttggtgatcatgaacagtgctgttaacagtgagtccaggtgtttgcgtggacatttgctttcatttctcttgggtagttgcctcggagtgaaccggagcatcacacagtccctctgtggtcaactgaggaactgccagactcttcccaaggcagctggaccattttgtgtgcctgccagtgtagctgagggagcttctgagtctcctccaggctgctcatgcccttgcccttgcccctgtgccctgcaggtgaatgtgggagctggcagccaccccaacaaggtcaaagtatacggccccggagtagccaagacagggctcaaggcccacgagcccacctacttcactgtggactgcgccgaggctggccagggtaaggcctggctgtgggtgggagggcaggtggctggggtgtccctgcgaggtctcagcctccgctcctctccccgccgcaggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggtgggtgctgcgctcctggccgctaagatgtcattgcggatgacgtctgccctcctctaaggccttctcctcccactgcctgcaggccacgcccaccagccccatccgagtcaaggtggagccctctcatgacgccagtaaggtgaaggccgagggccctggcctcagtcgcactggtgaggacaggtaccccatggcaggttgcggggcatcaagggtaggagggcttggggcagggtgcccctacatggtccctgtgtgttcctcaggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagcaggtagccacaccctccactacagtcaccgagtccccagcctcctcatgcagcagcctaggggacagctccgagggactttctgcccactctcattccttacctgggagaggacaggcatggaggtccaggagggggttggggagcaattctggtgtctctaaatacccccttcccttctgcacccttcccagggtccagtaggcgtcaatgtcacttatggaggggatcccatccctaagagccctttctcagtggcagtatctccaagcctggacctcagcaagatcaaggtgtctggcctgggagagagtaagtagttggggcccttgtcgcaaaggcctttgtcacatccagggattggctgagctgggtgtcatgtctctctccttcctttcatcgtttccacagaggtggacgttggcaaagaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaaggtaattggggtatgggaggccctaagggtagaacccactgtgctctctgagggccccaaaggtaccccatcttctccagacctgccctaaatccttttttttttttttttttcctgagacagactgtcaaccttgaccctgtttaagtgagagtaaaggggaggagggaaatagaaacccacaaaaagtcatcagggttgaagaatttcttttttttttttttctttctttttttttttttttttttttttttttttttttgagaaagagtctcactctgtcgcccaggctggagtgcagtggcgcgatattggctcacggcaccctccgcctcctggcttcaagcaatactcctgcctcagcctcccaagtagctgggattacaggtgcccgccaccatgcccagctaattttggtaattttagtagagacgagatttcaccatgttggccaggctgttctcaaactcctgacctcaggtgatccacccaccttggcctcccaaagggctgagattacaggcgtgagtgaccgcgccctgccctcctttttgtccttatgactgatggatggcccatctggcaggcagcctgggcccgcccgtgtccctgtttggtgagggcaggaagccagggcaaggggaggcaggtggaaagtcaagcaggaggtctgggatcggggcatagtgtggccttggctcctgaccccttcttccctcaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgagttgccctgccgtggggtatgtgacgggggacagggaccagaacccccgagccccaagcctcctctctgtgcctttgcaggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggtgcgtgctggggactcccacaggctggcagacggggtgggtggggtggcccgggctcctcctgacctggcctgcactcctccaggactgcactccgtggacgtgacctatgacggcagtcccgtgcccagcagccccttccaggtgcccgtgaccgagggctgcgacccctcccgggtgcgtgtccacgggccaggcatccaaagtggcaccaccaacaagcccaacaagttcactgtggagaccaggtaagggagcccccaggagcccgtgtggctggtgggcctgggaaccccaggaatgaccggctgtctgtttggaccaggggagctggcacgggcggcctgggcctggctgtagagggcccctccgaggccaagatgtcctgcatggataacaaggacggcagctgctcggtcgagtacatcccttatgaggctggcacctacagcctcaacgtcacctatggtggccatcaagtgccaggtgaggaggtggcggccagggcagggctgggactgtctgctcgtccccaccctgtctcatacagccgccatccctttgccccaaccctcaggcagtcctttcaaggtccctgtgcatgatgtgacagatgcgtccaaggtcaagtgctctgggcccggcctgagcccaggcatggttcgtgccaacctccctcagtccttccaggtggacacaagcaaggctggtgtggccccattgcaggtcaaagtgcaagggcccaaaggtgagtgtttgcatgcctggagccaggggtcaggagggcagtgtcctgtttgagggccgggaaaggaaactggaggcccaaagtgaggaccagagtgcagaggtggtgcaagtgtgtaggtgtttttggaagagcctcaggtgacagtgcagccaggtgggggacttggaggaggtagagcagatgggactggtcactgagcagatgtggcaggaaggcaggcaggcaagggtcccagctggcacccagatgggtgtctttcgtgccagagggggtcaaggccattcccagggtcgggtggatgaggataaagcgaggtctaggcctggggctgggtcctggccgtccagtgtggtggggtaggaatggaggcccaggagactagctgatgctctgtccctggggctggggccaggcctggtggagccagtggacgtggtagacaacgctgatggcacccagaccgtcaattatgtgcccagccgagaagggccctacagcatctcagtactgtatggagatgaagaggtaccccggaggtaagaggcagggcctgctgcctgtggggagtggcccaggctggatgctgagaacctgtctgactgctcacaacaccaatccctcacagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggtgagctccgggcacaggcaggggaggcaggggggcctgggcggctggagtgtgggctgcgggtggctggtgtctgatctccctgcggagctgcaccaaggagggcagggaaggacagggcccctgtctttggtttgctaaggttgtgactaccttaggatggtggtgacaggcacaggcttccccagacgtgcacttgctgctaactttgagcacgtcaccaaagccttctgtgcctcagtttccccacctgtaatattctcatggggcaggtataggatagaagcttgagatcaccccggtgagctcctcctagtgctggccaggccctggggctgaggatgggtgccaagctggctggccgcgcctgttgtcatgtgggaagtgtgggatgttttagtctccattctggactctgccaggtgcaggcagcccttttgggccatagcagttaagatgcctgaggcccagagactgtccctgtagcagcagcgctgggcactctgggagcgcctgaggcaggcccggggctactcgggcttgggccaactgcctcccctgcctctgccacacaggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacaggtgagcccgcccgctgttggccgctgcggcgctcggcacggggcttgggttgtgcctgtgtgcaagggctcgctgcttggggcggcgtgtgggagtgggggccgcccccttgagtgactcacctgacctttctccttgctctctgccctctcacctcagtgtcaatcggaggtcacgggctaggtaagctgcttgctggggccactcccaatgcccctcctgcccagaggggcagcttcctttcctcttggggccgattcccaggacagttccagctgcagctctaggcagggacagagttgggtggggtgcagaagatgaggccgtgggctggagggcgagggcccagggaggcttccggagctgagcatgaccgctccagctcttcccctctctgggcctttatttccccatctgagaactcgggttgcagctgagagctttggggtgaggtgcatcctgagaggcaccccactggggactttggggtctcgggatcttggcacccagggaggcacaagggctcctgcgtgggctgagggaacaaggggtctccccaactcaatgggagccccagccctggccagatccacagacccccatccccaccttccaggggcctctgcgtcccgggccgggggaggtgcatgagcgggtggggctggctggtagtgcagtagcgccagtgtcgactgcttgggcggccagcatggcggggcccggcccagcctcagagccccaaagtgcattctgtggcccgtctccctccttcccccttcccctatcccccagcagtgacgttattcagacattccccaacaggcatggagggtcacctgccccagccagggacacccagggatgctgatgagaggctacaggcctggcacttgggcgaggtggctaaggaaagggtgagagggtggctagagttttgcggcaggagcgagatggctttatagagcaggccgtaggatccgatgtgtgtgtgacaggcgtgtgtgcgcagggcgggggaggctggggagtactgattgcagggccttgggggctttgagggtgggagcaagactcagtaacctcagtttccctggctactgtttgcagaatggagacagggagcccggggtggggaagggggcgctgaagttgctctctggcaagcttgacggccacggggcttcagtgagagccaaattaggaggcatactttgaggatggagtggctgagacctgcggttggctgggagccgggcagggaaagtgggggcagtcgggtacctgtgaggttggggcccaagccactaactagatggcatggggtgcacatgagtgaagcctcccagggcagcgtgggcagccggcagccaggtctggagcctgggagagctgcctggccgcggcaggccagcatggagcctagtgcagcaggagccctcggccgatagtgggacttggtggcagggcccctcgagcttggccttcaagtaggtttcgtgctcctggctgcttccctggcaggaggccaggctgcagggggcactctcactgccaggcctcacagcccacagccccccaagcctccacggcggagacccagatcataacgtcactgtctctcccctttcctcgggcactctggggccctggagcctgctcagctgctctgccctcgcaacccagcagtggtggctgtagcttgggcctcctgttccctgtctccctgggtgctatccccgctctgccaagcctgctgcgctgcgctactcgggtgctaaccccgctgcctcccgcttccccgctcccactcctgtctgcaccgggctgcttttcaccgcgagccttctcagttgtcaggaaactccggtttcaccatcaggcctggggggtggggaggcaagtgtcacatccccccacgctgcagcaggactccgcctcaccgcgtccacacacagcaatgggggccggggccaggccagaagggcgcaggcagccgtgtgcccagccagatgctggcgttcagcagtgtgggccatggtgctggacgaggctgagtaggcaagggagtggctgtcaacacttaggctggagtgggcccttccttttcctcccaggcacctgggtgctactgtcgggcctctcccacatgggcacttgaggtggtcaggagaaaccttcctgccttctgagaaaccactcgccatcccagcttggaggggcagggcggggcaggaggcctggcggcctggctgtgcttggtggtggcaatgagaggcctgtgtgggcggcaggcggacgggaacaacctgaacccgagctcacacgctggcccccctttggggacccaccctgccccaccaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggtgaggaggggtggggggtaggtcagcaggggtgtctggcaggtcccggcctgttcccctggggcccctctgtgacaacagactctccagcagctctctgctttgccctgcaggctctggctggggaccagccctcggtgcagccccctctacggtctcagcagctggccccacagtacacctacgcccagggcggccagcagacttgggtacggcctggccagctagggacactggggctagccagctgggtgttctgtgagcccctagtttaccatgtgtgaggagggaccccagatcctcccactgtccctcacccatgccctgtgtctccactgcaggccccggagaggcccctggtgggtgtcaatgggctggatgtgaccagcctgaggccctttgaccttgtcatccccttcaccatcaagaagggcgagatcacaggtgagtggggacttgggaaggagctcgggagccaaggaggccagactgtgccaatgagctgccctgacctcagccccactgccccacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggtgggcctgccctgcctctgcccactccaccgccaccacctcacagagagatggggctgggggacacacgaggctgccattccacaaggcccttcttcctgcctcaggaagccccttgcagttctatgtggattacgtcaactgtggccatgtcactgcctatgggcctggcctcacccatggagtagtgaacaagcctgccaccttcaccgtcaacaccaaggatgcaggagagggtgagcaatagctctggtcttgacctgctctgtgcccgggatgccctcaccggggtaagggctggactcaggagatactcctgaatggggctccctgccctgctgccctggccatcggagctcctcagtgcaggccaactggagtgtccccagcatagttcccatgctcacccacggctctctccagggggcctgtctctggccattgagggcccgtccaaagcagaaatcagctgcactgacaaccaggatgggacatgcagcgtgtcctacctgcctgtgctgccgggggactacagcattctagtcaagtacaatgaacagcacgtcccaggcagccccttcactgctcgggtcacaggtgggtggcactgggagcagtgacagaaacgggtggcagggtgggcatggtctcccatggctggacgcacactgatggctggcctgtccccaccaggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtgggtaagcggctgaagggtccagggggttcagaaaggaggcagcctgtggggagccatgccctccctgactgacagccatgccctgtgtccagggatttcattcgtgcccaaggagacgggggagcacctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggtaggcagtggctgcccaccagctggggcgggagcactgtgcatagcaccgaggctcaggggtatccatcccctaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctggtgagtgcagcagtgcctcggcagcccccctcactacaccagggcccacaggcagtatgtgactggaggggcgtgggccgtgctttcttcctgcaggcagccccttctctgtgaaggtgacaggcgagggccgggtgaaagagagcatcacccgcaggcgtcgggctccttcagtggccaacgttggtagtcattgtgacctcagcctgaaaatccctggtaggggctgtgggaagcctggggaggggtcctggggctcaagcagccccaagaggaggggtggagcccagggctgctgctcactagcccatccccaccctgcagaaattagcatccaggatatgacagcccaggtgaccagcccatcgggcaagacccatgaggccgagatcgtggaaggggagaaccacacctactgcatccgctttgttcccgctgagatgggcacacacacagtcagcgtgaagtacaagggccagcacgtgcctgggagccccttccagttcaccgtggggcccctaggggaagggggagcccacaaggtccgagctgggggccctggcctggagagagctgaagctggagtgccaggtaggcctgctcacaccccgagtgctcgctctcctgcgttggccagggtggggttgggggtggaggaaagagccggcaggcatgtctaccttggctatgcctggagggggccgaggctggtgaagcagccttcagtgaggacaaactgttctcccacagccgaattcagtatctggacccgggaagctggtgctggaggcctggccattgctgtcgagggccccagcaaggctgagatctcttttgaggaccgcaaggacggctcctgtggtgtggcttatgtggtccaggagccaggtactgggaacccggctggggttggaggaggtggggcctgagtgtgggtattggacccagggctggcacagatagccctgcctggcactcactcttcactttgaggtcacagggccacccaggctgttcgtgggaggtgggaggcccaaaggctgatgagccggtcttacactctttccctgcccaggtgactacgaagtctcagtcaagttcaacgaggaacacattcccgacagccccttcgtggtgcctgtggcttctccgtctggcgacgcccgccgcctcactgtttctagccttcaggtgaggcaccgagagaaaccgcccacctggggctcctgggcccggacagaccagagccaccgcagagaccaggccttggccctgtgttcagtgacccccctggcccagctctgggttccaggcctctgctctggccgggtgcagcccacgcttggggtcggcaggaaatatcctgcccaccacgtggagtttttctcgtgtctcaggtctaaaggctttgaacagaagcctgtgccccttgagcaccagggctgcggtttaaagagggacagcctgccaaggctgggtgctgcccacagggtggggcagccctcccttcctgccacctgggtgtgtgcgacggcagagtgtgggggcaggggcggggatgtgcgcctgtggcttgctgccccttgcaaatcagtggctctccctctttaaaccaagttggacgccagatgggtaagtgcgacccgcgggcctcttgctcctggggcctttccgtcctcccttgccctggctcaagcacccccatctaaccatgtctgctgtgcttccaggagtcagggctaaaggtcaaccagccagcctcttttgcagtcagcctgaacggggccaagggggcgatcgatgccaaggtgcacagcccctcaggagccctggaggagtgctatgtcacagaaattgaccaaggtgaggccctgtccctgcccggccgccctgccctgctggctggaagcaggctgagagtacaaaaggaaggtaccgcttctgtaagcagccaagacggggccccaactcctgggccccctaagccaggcaaccctttcccaattggtgacccaagccgctggggatgtggctcgccacccacagctattaggaaggccttctaccctgcagtaccatgccatctccacagggaaagactcaaagtccagcctcagtgctgcccggcccttcagccacggccatggtacttgtgcacaggcctggggcagccttgtgggtaggaggagcccagtgggcttcatttcacggcctagtcctgcccttcccagctgcatgacctgaagcaagttcctgcccgtctctgagcctgttaacatgcaggggatatggtgttcacggtaacctttcttaggaggcagcaaggcctgggtttggcttgtaaaagatttccgtcccaatgcaccctgacggtgggcagcttgagtgtctaaaccttcggccctcaggaggtctgctgcggggtgcaggtgcccagcgtggctgggctcacactgatggaccggcaaaatggggagggccagggttgaggctgttcctcacagacaccatctgctggtttgaggaggggccccaggcccacagcatgactccctgctcctcagataagtatgctgtgcgcttcatccctcgggagaatggcgtttacctgattgacgtcaagttcaacggcacccacatccctggaagccccttcaagatccgagttggggagcctgggcatggaggggacccaggcttggtgtctgcttacggagcaggtctggaaggcggtgtcacaggtaagtctgtcggtgcggctgcacgtgtgcacacagctgctaggcccttgcctccaagctcttggtgacaacaggaggcacctggaggtgacaagcctgtgctgggtggccgaggacagggaggcaggccagtctggctctgcctgacctcctgtgctcccagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggtgagcctggggccaagctattggcatctgcccaacgcccggcaccacagccacctcttagccccacccactctgccttgcaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggtgggcaacccgggcccccggcccaccttcccaccaaaatgaggccagaaatcacaggatggccagtgtctgggagagcagggaccgcctttggggcgtggctttcacttctagagccacctccctgccacctcctggacccctcaaacaaagaccagggaggagctggaatctgctaagctggcctgggttggggaggtgctggcagctctttaggaagagagaactgtcaccccagaactggcttagggacaggagaggagagcaggacaccagcgggaggaagggggctgggacctgggactgaggacccctcttgcctcaggcaacaacatgctgctggtgggggttcatggcccaaggaccccctgcgaggagatcctggtgaagcacgtgggcagccggctctacagcgtgtcctacctgctcaaggacaagggggagtacacactggtggtcaaatggggggacgagcacatcccaggcagcccctaccgcgttgtggtgccctgagtctggggcccgtgccagccggcagcccccaagcctgccccgctacccaagcagccccgccctcttcccctcaaccccggcccaggccgccctggccgcccgcctgtcactgcagccgcccctgccctgtgccgtgctgcgctcacctgcctccccagccagccgctgacctctcggctttcacttgggcagagggagccatttggtggcgctgcttgtcttctttggttctgggaggggtgagggatgggggtcctgtacacaaccacccactagttctcttctccagccaagaggaataaagttttgcttccattctcctttgcgtggctgtagctttgttggggttgggggaccagtcaaggccaacctgacaggggtgccaatgagcagatcaaagcatgggctgagcacaggtcacctccctccagggctcctgcttcaccccaccctgactccagaaggcaccatctatctttgcttcctctgcctccctgagttcaagccaacgtaaggagaggaacatgtagcaacctggaatggagcccaggcagcaaggaggcaaagagctgggcaggagagcccattactgggtagggtggtgtcaggaaggctccctggtggaggtggccagataatcaacagcaggcccggccgggtgtggtggctcacgcctgtaatcccagcacttcgggaggccgaggcaggcagatcacaaggtcaggagatcaagaccatcctggctaacacggtgaaaccccgtctctactaaaaatacaaaaaattagccaggtgtggtggcgggcgcctgtagtcccagctactcgggaggctgaggcaggagaatggcgcgaacccaggagacagagcttgcagtgagccgagatcgcgccactgccctccagcctgggcgacagagcgagactctgtctcaaaaaaaaaaaaaaaaaaaaatcacagcaggccctggccatctgccaggtaacttgaacatgccaccatgccaccattcccccaaacaagggactgggatgaggccccctcccccaggctctgggcctcagggccctttagttaacaggtggcaggaggtggatgcattcaaggtgccaatcccaggtaccctgggccccctgctgaatatcccctcattggtacccctgccgtggattcccacaccaacctatgtgtctcccactgtaaagattgcccccaaacacataacatcccaagtcgtcctggctcctggtgctgcctgcatgctatcgggacatcccaactgcagcacccaaagctgcctgctccctgggccaaaggctttggccctcgatcaaacccctgacaaggacaccaccacctcagacatctgcagacaagggccaggaagcaaggctctcgggggcaacgctcagctttctcgccacatcctccctcagctccacagcgtctgacacgaccaggccgtagcctgcagccatggcacacgtcaaacccagaccttctgagacctcaacaccacgcgtaccctccttgacccctgttgagagggcaaagtagaaaaggcagcggcagttcaggcaggatggctacttttatttctcactggggctgggctgctggccccaggctcagggcggccactcactgggagacacggggcaagcaagacacagaaaggggaagtcccacccccagccgcagccactctactgctccccctgggcccaatggcatagaggtaaaggggccaagcacactctggaagcctctaaaagccaccagctgaacggggctgtgaggcagcagagccaggcccagaaagatgcagtgccagttgggaggacgggaggtccccctgaggctgcgacttgtccgctcagcccactgtgtgcccaggattctgaacctctggggcactccctcctgtcccgagtcacccagggtctcctgccccctccctgtgtctgctccatcacatcccctctcaagccccatgcctggcagggccaccgccctagggctgggctaggtgaaccaagggcaccggtcccccaaacctgccgatcgtccccaggctgcagggagggacacatgtggggcggcaagggcagaagataaactagggggatccgggcccctgaggacagccctggcgggaggccacaggcctcacagggtggtgagctggaggccacccaggcaggcaggcaggcagcagggaaagagactggcacggtcctggccagggccccccccgggaagggcgggcaagtaggagcaaaaacaagagcagagcacgggcccccaccctgccgggtcctatggcctggggactcacacacactgaggaagacccaggaggacccgccaggctactaggaggagataaagggtgcacaggcctccaacccgcaggttgtgtctggactgagtccagggagggcagggaggggcggtagcccagttgaccttccctcccccaagccacacctctgcaccccaaccctcccttccgcctcccaacagccccatccccgctctccgaggaaactgggaggggacctggagaggaaagggaagcaacggcccctcagagcggggttccccaaaatccatggccagggactgaggccagcactcagacactgttgggaacactggccaggagtccctcggggtggacctgggaacctgctgcagaagcttaggggaccgggccagctcaggaaagggctcaggctggaaaccgagcagacagggcaccgctggacctggggccgaggaggacaggaagtaggtgactatggaaagacccccgccgccacccacgcccaactcggcacacaaaggcccagagaggcccccagacatgcctgtgggggcaggggtgtttgcaaacatttgcagagggaccgggtgtcccaggcacatggacagcttgcagggcccggctgaggctaggacagcagcaggtggctggcaggaggtgccccgccagggtccccaactgtgtggggggcaggcccgaggcaggcggcaccagtcccgggcaggatctctcggaagaggggccgtacccagccagggttcccagagacacgggtggtggggccgagtgccccctcaccctgtgcctggcccccaacaaagggtgagcatgtatccttcctggacacggtgtccagggcagggcactcccgaaccaggatgccccctaggccacaggacccctcagccccagctgacagcagccgggggggatctggggaggcccccaggaggcagggcggcagccaagcagaacaccatccctggacccactctccaactgcaaccagggcccgctcccccgaaggcaccagctctccctaggggcaggaccttgatccagagcaggagtggaggcccccaacaggggacggctggagaggccctgggctcacgagccagggagcggcgcctctgtgcccggaagcccctgggtcctgcctgggctgctggtagctgctgcgggccgaggggtccggacgcccctagggtgctctggggcagctcctttgggaccctcaatggagccagtaagtccaggagggcgccgatccgtccaggtgggtgcatgggccgggacagggtctggctgctgtcgtggctgtgcccatctgccgaacaggtcgctaggagagcactccctgagcgagggcgccgggcagcccggggagggaggacacagtccccgtccaggcccccgaggcccccatagcagggagagccggccctcctcgctgttcttcccgcgggatcgggccggcacctcggctcaggggagagagggtcacagaggacagccagcaggcaggtggcccaggagtgtggggggtcggtgggcctgaccgtgtcctgaagcaccccaggaccctgtacccgacaccctgggggaggggctgtccccacttgccaggaacacattcctcagggaaggcccggcaacctgctctcgtcgggttcaagaagggccaggcggctttggaaggggccaggagctgtcaccaagggcccccgcattgcccagaggcggcgcgggccaacaggaaaagcactcaccgcccacggaacctctgtgacaaactcagagccacggagagcgtcatcagcaagtcacttgccagtcccagtgggaaggatggggcacgtctccagggaaacgagacaccaaggtcttcctggggccccagtggaaagctccttccaggacccacctggccctccacatcccaccctccaggccagggaccggagcccagtatccggcaacctgacacatcacggagaaaaggagctgctctgccttcaccatgacgacgcggcacaccccctccctgccccggcccctccccttcagggctgcatgcggggaggagaggcctcccctgtctgcagagagaggctgccccacctggggcagagaggggacaggggcaggaatgagcccctgggaggggggcattggaggtggggggcacatcctgccacccgggctggcgtggggcactcatgccatgcagaccagaacgggcttcccaccggctcctggggatgttggaccggggctccccgaccagggctgggaaaggcttccatgaagagccagagagcacacggcgcagaccctgcggggcacacggggtctcggtggcagagtctcccttcttggggttctctgtgatgggttttgcaaccctttcaggatgtcaaagcacgccccgccctcagaaatgcaggccccggccagtgtcagccccaggaggtggcctgctgctcccgctgacaccaaggacatgttcctgaggcggcccgctcgggatctccagcagccgacgcaggtctacacgtgcaagggtgcttctgactcgcagcactcaggaacagcctccaccctgagcgtggcgccctctccagcacgcgccagggtggacctgtgagaccaataaaaaccacagcggaggcgaggcgagtcacttaggagaccaggccatgaagagactgtggccgggtctggggcgccctctcctgctggttcgactggattgcaggtccgggggaagcccagcagccctggggaggaggcccggtggggaggaactgaggcctcctgccacagcctccagagggagagtcatcacgagggctccccacccagtcagataggatggctgggccccagtggacacctgaccgcagcctgagagggaccctgagccacagtcctggctccccgagagccctcccagagcctgtccctcagaacccttgggggggtgacacgagtgctgggggggtgagacgagtgctaggtggggaaggaccgaaacgtgaagtcgtctgttacccagtagtcggaactggtgcccagcgtccagggggcaagacacggcgtgagccagaaggaaacaaaccgacaagaacccccagaagccatcaggaaagcctggagattctgatgacacgaaaactaaaatcccctctgtgaccaagcacaacccgcaaaccacacagtcaagagacaagtgataataaggggagaaaatagtagcaagaggtgactaagggctcgcgtcagtcacacacacacagagccggacacacggacaaggcaaagtgcaaggacaagagagcaaaagggggcggaggagaggaagggagagggaaggaagcgtcttctccaccgggatgcaattccttgggagcccgtctgaccccagggcaaagagatgctgggtcgccagagccgccgcggagaagtcccgccgggcctcagagcccagcaaagaggaaccagggcggacgggccaaacccagcggccggctcccgggggggtgggtggtggcgctgcggggagtcgcctgagcagcatcaccagcagctgggaaccctcccggtgcgggaaggttggcgggtaaggcggggcttccccggaaacactgggctggacccagcggtcccatgggtgctggaaccagccctgcgggtgttcccaggcaccctcccgcgggaagaccggctggagggatggctcctgttggcacccacgtcgagggaagccaccgccttctctgcggggctcgcctttcctacctcccccaggagacagtcaggccaggaagcgccccagcccacgaccgcccgcagcagagcaggattccctccccggcggccgccgctgtcaagggacggggaagactttgttaccccaccgcgcgccaccgcggaatggtgcacagacacctccagacgccacttcccccaagacggccgcccgccccgctctgcccacctctccctggacgctgccgggtgggcgcggccctgcttccccacgaccccccagacgcgccccgaggcactttcgcagcacagtggagtgggaagggcggggcggcccctcgacggcgccgaggcgagagcggctcacggggcttcccgggccctgatctcaggcgacgcctgtccgcctcgtccccgggggaagacagtgaccaccggtctgcaaaggaaggggactcggcgcatgccccgcagggccggcccaggactcgcaggcgcggaaggcggtgccgaggcgggggcggggcgtggagggacagccctagtctccgcccgccggggcccacagctgcctcgctccccgcctccgcttcggtcgctcctggtaagctccaggcgcccacgggaagccccgcccagccccgcctatccgtcctcctcttcgcctgtcctcgccaatgaccatgctcagattgcacggaattcccgcccctcgcccttgactgacgctcctgctgcccagtggacgacaccccgtcgcgtgcgcgccgctgcggccctgccgggtgtggcgcggcgctctcaggctcctaggcgttcccggggcgagacccagggcgctggccgcagagtcgccggtgcacacgcaacagtgccgccttgtgttttgggtgtggacctgcgcttctctaagcgttccattcccgagaaggggcgacaaacgtccagaggtcgtggcacctgcccgccgctgccggggcgtcggccgtgggcgcaagtgaagcgccccgggagcgcggcgcgacgtccgtgccttccgagggcggcccgggtgtcgccgcggtgcgcgcgggagggcgcggccgtgggcatttccgcgcttgcgcgggttcctgtcccgccccggccccggccccggccccggccccggccccggccccggccccggccccggcccctccctctcgtggccccgcagtagacgcagcccctccctcccgcggtgcagcgcagccagggctctgctccgggagtcatggagtccatcaccgcggagcgttatctcagcggacccacgcggtgtcctccgctggggtgggccgagtaccctccgcctcccgcccgcgagatccatcccagcccctggcgggggcccgtggttcttcccgctcatggccacggaacggtccacgctcgcggagccgcaggctgagcttttgctggtgagggacaaggtcgtggtttcccgtggctggtggccctcacggaggagcctgctgggagcacgcccgtgtagggtttcctgtcatcgggttgccacgcccatcttgaacgctcgagtccacgcagaagtgtagaagtggatgtgtagctttatttgtaattctctttctttcttcctttctttccttctttctttccttttctttctttttgagtcagggtctcactctgcgcccagtctggagtgcagtggcgcgatgagggctcactacagccttgacctctccaccccagcgagggcttcaacctccagcctcagccttccgtgtagctgggactacaggcgcacgccaccaccatgtccggctaattttttactttttgtagagatggggtctcgctttttcgcccaggttggtctgggattcctgggctcaggtgatccaccccagcctcacaaagtgctgggattctgggcaccgcgcaccggccgccgcgcccggcttgatgtgtagtttcaatagaaaccaccaaggtcttcagggtggcctgtgcatcactttacacatactcaagcgaatcattgagaggtgtttgaggccgggcgcggtggctcacgcctgtgatcccagcacttcgggaggccgaggcgggtggatcgtttgaggtcaggagtttgagaccagcctgaccaacatagtgaaactctgtctctaataaaaatataaaattagccgggcgtggtggcgccctcgcctataatcccaactactcaggaggctgaggcaggagaatcgcttgaacccaggaggcagaggttgcactgagccgagatcgcaccacggcactccagcctgggtgacagagcaagattctgtctcaaaaaaaaaaaaaaaaaaaacgtttttgaaacaacttgaagcaagttatcccatgtataaaaaagcatgaagttatttatactatttttctgtgcaatcacccacataattagccaagttaagacccattatgcggccgggcgcggtggctcacgcctgtaatcccagcactttgggaggctgaggcgcgtggatcacgaggtcaggagttcgagaccagcctggctaatatggtgaaacctcgtttctactaaaaatacaaaaattagctgggcgtggtggcgtgtgcctgtagtcccagctactcgggaggctgaggcagaagaatcgcttgaacccgggaggtgaaggttgcagcaagccgagatcgcaccactgcactccagcctgggtgacacagtgagactccgtctgaaaaacaaaaacaaaaaaaaaccgttatgctacacgttttgtagtgattttgttttgtttgttttagcttttttataatttcaacttttttgtttttgagatagagtctcactcttgtcgcccaggctgagtgcaatggcaccatctcggctcattgcaacctttgcctcccaggctgaagggatcctctcacctctcacctgggttggtcaggctggtctcaaattcctgacctcagtgatgcaccagcctcggcctcccaaagtgctgggattacaggcatgagccaccgcgcccggcctgatgtactttaaacttttttttttctttttttgagacagagagtttcactcatgttgcccaggctggagtgcaatggcgtgatctcagctcaccacaacctccacctcctgggctcaagtgattctcctgcctcagcctcccgagtacctgggattacaggcatgtgccactgcaccgggcctccatttgatgtacttttaaagcattattatttctaccttgcatttactatgaacacagccttgaacgtgcatccatctctctctagaataattacctgtaagtggaattgctgggtcgagatatatgtacattaaaaaaaaaaattttttttttttgagacaggatctcagtctgtcgctcaggctggagtggagtggctcgatcacagctcaccaccgcctcaacctcctgggctcaagtgatcttcctgtttcagcctcctgagctgctgggaccacaagtgtgtgccaccatccctggcttttttagaaaacttctttttgtacagacagggtctcactgtgttgcccaggctggtcttgaacccctgggctcaagtcctccctccttggcctctcaaagtgctggttttacagatgtgtcccaccttgtgtggcctgcatttaaaattgtaagagacactagggaattgcctcccctaaagaccctacctttgatactgtccgtccctcgcattgtaccctcagcgtttacccacagcctcaccagcaccttttgggctaacagctttttaggtagctgaaaattagatgggagaactgtagcttttcgctttttccttcttccctgtttcctagtcctgttcccctccctcccaaaggggtcatttaaaatgtggtgtcatttggaatgtgtttgttcaattgtattttagttttctgagacagggcctcgctttgtcacccaggctggagtgcagtggtgtgatcatagctcacggcagccttgatgtcccagactcaagtgatcctcccacctcagcttctggagtaactaggactacaggcatgtgccaccacgccagctaattttatttttttgtagagacgaggtctcaccctgttgcccaggttggtctcctatttctggcttcaagcgatctgcccgtctcggcctcccaaagtgcttggatgacaggcgtgagccactgccctgcacctgtggattttttgtgtgtatggttttgcccaccgtaactgtccctgtgctgcattcctattctgctgactgcttccgtcattcaacagggtttctcagctctttgtctgtggccctggagacgtacagttgactcctgtgctcctgcagaggatttcagagcttggatgcaacacatttgatcattcccaccctgagtgatgcaaccccagggcttcagctcctggtgtgccacaaaccatgccacgaaggccatggcacggaatgtggccttagcgagaagggagaattgctcttgctgaggttatcaaggggtaggattgctgggttcaagaacactgatgtttcattttcttatgtttgttctgttctttttttttttttttttttgaaagagtctcactctgtcacccaggctggagtgtagtggcgcgatctcggctcactgcaacattcacctcctgggtttaagcaattctcccacctcagcctaccgagtagctgggactaaaggcgcacgccagcatgcctggctactttttgtatttttagtggagacggggtttcaccgtgttggccaagctggtcctgaactcctgacctcaagtgatccccccgcctcggcctcccacagtgctgggatgacaggcgtgagccaccgcgcctggctcctttcccattttctaagggacagtcagtctcctccataccatttgtcacacagcctttcccccatgatggcactgccatactcctgctaaatgcgcaggcatctgtggtctcctctgcacttgtccttccagggaacgatgcagtgggctccttgctttgcatctcgccatacctggtgcacctgccagctcccttagcaggaccttgcagacagtttcagtcattcttgggcattttcttctccatgtgaagtttcccatcatcttgtcccggaccattagacacccacatccctggcttcctgggactctggtggcgtgatgggaagagcccacttcttaacattgttttttttcaagaggatctcattcttagtccaggtggcaggaatggtttcccctgctggcctcagctctgttggcaagggatacctgcagtctggggcctggagttggagcgctccagacacggtcccttccttccgggagtttctttctcgtgggtgagccagaagcaaacacctcatcccacagttctgagggcctgggtggggccatcgtcctggtccaggtaagagaccatggagtctggccaagcacgttggctcctgcctgtaatcccagcactttgggttagggttagggcaggaggatcacttggctccagcagtttaagaccagtctgggcaacctaacaaggccccatctctacaaaagaaaaaaaaagttatccaggcatggtggcgtgtgcctgtagtcccagctgattgggaagctgaggcaagagcatctctggagcccaggagttcgaggctgcagtgagtgttgatcatgccactgcattccagtctgggcaacagagcaagaacctgtctcaattaaaaaaaaaaaaaagccgggcgtggtggctcacacctgtaattccagcacattgggaggctgaggcgggcagatcacctgaagtcaggagtttgagaccagcctgacccacatggagaaaccctgtctctactaaaaatacaaaataagccaggcatggtggcacatgcctgtgatcccagctactcgggaggctgaggcaggagaatcgctcaaacccgggaggcagaggttgcggtgggccaagattgtgccattgcactccagcctcggcaataagagcgaaactccatctcagaaaaaaaaaaaaaaaaggacagtggagtcctagatggcgagggtagcaatggagaaacccacttcaatttctttgagccaacggttggaaggattcccgtgggaaggtcaggagggagaggagccaacaggtggaactccgacagttcccccgtcctcaccttgtagggctgcaagattccttggtgcctgtctgggctccagggcccccacccacccctgcaggcttatgtgcggatcagcaagaggcactctgctctcggggcaggtactcggctggaggcgaggacacgggagggatttcagccctctggctccccaggaaggtgtccttgtgccgagaacagcctgcacgaccttctagggcacccaggattaggctgtatcctccctctgcccaaactggctacagaaagttcattttaatgcccactagagagtgaggagactgtaggtgcaatttctttgttgtttttcttttttctgagacagaagagtcttgctctgtggtcccaggctggagtgcagtggtgtgatcttggctcactcaaacctccacctcccaggttcaagccagattctcctgcctcagccccctgggtagctgagattacaggcacgttccaccatgcccggctaatttctgtatttttagtagacgtggtttcaccatgttggccaggctggtctcgaactcctgacctcgtgatctgcccaccttggcctcccaaagtcttgggattacaggcgtgagccacctcacccagctgtaggtgagatttctgagtgcccgttacaaattcctgattgacccaagctgggcaggtcgccccgccacccctgtccagctatggcctgtggtctaggttacatgagccagtgctaactaggctgggatgagcatcacacctgttagaccccatcgcctgtcctccatgcatccttagtggagtttgggagaaggcaaggaaaggagcaatgatacaacttgtagttgtgtcatttcaagcatacctgggccacaggtgagtgagggccgtccctgggtggaaacaaagagcaaatgaaaacacagaggggtcgggactcggtggatcacacctgtaatcccagaatttttggaggctgaggcaggaggatcactggagaccagcctgggcaacgaggtgagaccccatctctaaatacagagaaaaaaatagaaacaaccaaaaaaaaacaggcctaagcaggacctgacgctggggccgtgcagaagcagcttgctgcacttggtcttgatggcctctgggtcaggaggccttgtgccttcaggtgagtgtgccgaacggaacccctcagctcaacccagtgtttttgcaaggttacttccgggataaaggaaagatgaggtgagcgctgcctcagcacagggagctcagggatagcaggtccatgtcagcctgggtctgcgtgagcaggtgagaaggaatctgcctgcctcccagcaggtgccctgagcaccctccagcacggcctgcctgcccacaggcacggggaaaaggctcaggtctctgtgagccctggctgatagatcaccttgcctccttagtgcggtcatactgctgggatcctggcagagacaacctaccttccatagaggggacacgtcaccccaggattctgccacaggacttttggaggtaaagctgaagtggggcccacagcctcacgatgacagcactggccaccgtcatggagagtagagtcagtgggcaggtcaaagagtaaggctggacctgtcagggttccggggtggaatcctcaaagatccccaatcacatcattgtcagcaatggctgggagcatccaccccctcctcacagcagccctaggatgtcggtgccagtgttacccccattttcagacaaaaacaggagggaaatgtgactcatgaagttgggctccagagcctgagccctttctcggctttgctgcactccctcccactcctgccctttggagattccccgtggtgtgtggtgtgtggtgtgtggagtgtgatgcatgtggaaggaaggagtcggaggcaagtctggctcagtatctcccaggcctcgggtcatcacgcgaaaaacagaggagggtaaaatgagaaccgctgttctcctctcgggcctgatcggctgaactctgcaagcacagactgaccagcttagaattctcagcagatcacagagcagttctcatagatgtttgcattattgtgatgtaaagctactgacttctcagatctctaatagtctctctgacacaacaacctaagggtagaaagaaagagatacaaaagagaagagttagaaatccagggagatttgaaaagcagcacgtacataagcctagtcattgcaatgaaaatctcatccaatggactcaacagcaaattgatgcccctgaacacagaatgagtgacctggaagacgatgccaaagacacttcctcctgccccgttcttagcagatgatgtggcttcctccttctgtgacgcactgcagcagcccctcctcgaggtccagagccctaggccttccatgctcccaggctcagtactagactcctggtcaccccaacatctttatttttgcctccctgctctgggggttgtagcttcttccttcaccaactctgttacttcagtatcccttttgcactttcagccctcaaaccccaagtaaatacgctttcacttccctttcttgagatactaggtatgtatttttgtctcctaactggttcctgactaatccagaactggccctgggtaaggttctggaagaaaaggcctatgcacatggaatctggcgattggtctggtcctgcctttgggctggagtgcagggttgagcattttcccagtgggaagtggggcatgagccatccatggcctgcagtggcttcacaattaatctagctgtcacttcggttgcttgggatgatgggccaactgaaacaagcaccagggagctcaagtccttgctgcacctgacttgtcatggtggtcacggatggctatgagggctgtggtatgggatgatccttagtggccctgactatgtaccatgaagacacaatgggctcaggctccctaactctcagctcaagccacagtaacagaaccagggtgcttccaggaaaggcctcaaagttcccttactccttgtacttgcagggctgacagttctgacaatcaaacacattttattgtgccagttacagattcccaaagtgatgaatttccagcctcgccacatttcacacgtgaatcgtgggcagtgatgtgggaagaatgggaccctgaaacccggaatggggccatctggttggccttggttgaagctgagactcgagaagcccccagtccctctgcacctcccttggtagtggcggcggctcgacctcccgtgtctgggggactggtgtttctttgctggagaactctgtcacaagtttacctggggaggagccttgccagtggacactcacttgtatcatccaggagaccctctacaactagacctagaactagacctagaactagaatgttgccgttagacccagaactagcgtcaggtacacacttagggagggagggtatctctcacgtgggccctgataccaggtgcagcccaggtcctgccctgagcggtaactctgcgtgctcggcttcctcacccaagtacggaatgacacatcagatcattccagctctcccgaatctaacgacccagcttctctaaccctgacctcggcctggcagggcgaggaggcctcgtgaagtggtagaacctctcccggctgcccggggaaggccgggctccaagggtgaaggcgagtgcccacgggtaggagccatgccctccaggtagcgcctgaagcgtggggccgacggggcgggagggtgcgcggggccggcacgaggcggtgtttgatggtgggtagcaggcgtccagggagggcggtgggacagcggggacaggggagcagctcgggttgcacagggctgcctggcccagaagcgggcaggcgggttggttgctgccagccccaacataatcccagcaaggcggggaaggatcgtgctgaggggccgatggggctggccagccgagggcgtgctgggggtgctggggagtaggaagctgccaggtatgcagggtgggcctgcatgggtgtttcgaaaagatggcactaacatcctgaccacagctttgtgggatacatgctgtccccgtcatcagcaccatcatccccttctacagctacccaaggccccacagtcaagaagcagatttggggattcaagccaggttttgggacacatggttcccgagtccctgctggctggcttctccatgggaagtaatcagagcaataagatgttaggaggactcaagggcgaggggactggccagaggccagggtccatggcatcttccagggagtattcattaccaggttcttaacagttaacaaacacacgtgtttactcagaagccacagccaggccaagctggcaacagggctcactcccctcgctgggtgatcatggctcctatgctctcattcctttgatctgccctactgtttctgcctagaaccttctaggggactgaagtgaggctttgggggctctttcctgtgtttagaaattgcacattttaatcatggaatctgttgctccatttgttgccaccgtgcgcttatgtgtcctgtggtctcaccaaacctgacattttgcacctgaatacaagcaagcgtggcttgtctgttagaatgccttcctctaaagtaatgctttacagccaccttcagtgtcactgcatctactcctcacaaaacggtatttaaacaccaccccccaccacactcttgaaagggtacacagaattatcctacgacacagcaattcaattccactcctagtatacatgtccataagaagggaaaatctacatctacacaaaatctttcacatattttgtgaaacctacatcttcacaaaatatgtgaattgtcagaacgctattcacaagagacaaaagtggaactaatccacattcatcaactgaatggaagaataaaatgtgttatctccatacaatagaatagtatgtggccataaaaagaatgaaaaccactgaattgtataccttaaatgagtaaaattgtctggagtgtgagaagctgtgattacctcgaagtagtgagataagtgaggtaaaacatttttgcctctttgcattttctaaattttctgcaatcaccctatagaaactatttttacaaaataaattttgaaatcttatgaaataagcagagccatcatcatgctcattttacaggccaggaaaccagctcagtgacttacaagggcaggagtaggaggaggtcctgaggactccaagccccaggccagtgcttccatctctatcccgcacattctagaacaattcctcagtcacactggtcatgactccaaagatctctgaccacttaatttgggcaataaaaataaggaatgggctgggtatagtggctcacgcctgtaattctaaccccagcaccttggaaggtccaggcgtgaggatcacttgaggccaggagtttgagaccagcctgggcaacatagtgagaccctgtctcaaaacaaaaccaaagccaaaacaggaatgtgacacagcagacacatctagtagaattttaaatctagttttgaagctcaggttcatctttttctggttgacactttgattctagatacatacttcttaaatttttttttggaggtagagtctcgctctgtctcctaggctggcgtacaatggcaggatctcggctcactgcaacctccgcttcctgggttcaaacaattctcctgcctcagcctcccgagtagctgggattgtaagtgtgcaccaccatgtctggctaatttttgtcttttttagtagagagggggtttcaccatgttgtccaggctggtcttgaactcctgacctcaggtgatccacctgccttggcctcccaaagtgctgggattacaagcgtgagccacaacgcctggcctctagccacatactttatgtgcttatagctgacaggaaggcgtcagctcagggacagcttttcaggccaggtgctgtcctcgagcgagtgcttcctctgcagcccattattctttcccaggtttactggtgggggccatggctcactctttctggtttggataaaagctctttccttatttaggaactgaccactgagaaactgattcacacagaaggcacgtgctgaataaagcagctggttttgaaatgctttattaacattgacttgaacagtacagtgtggaggctctcatcacaagcagcacaggacatcctaacaagctttcgctgctgcctgacagcctctcaaacgtggagggagatgaaggcaaacagcgaagggaattccagggcagctgcaggtgggatggcagcacacagaatcccaaggtgggaacagcagtaggcgtcatggtgttatcgtgctgtggaaactaggctactggaatctatacttcaatccacattttctttactcatgaaggaaatacattgaaaaaactattacctctaccagttattcacgaaggaaacacttcggaagaattgattacctctaccacttatctatagtcttatcagaaaacttactatcaggtggttgttttgttacctatttttttcacttaaaagttgtgtaactccctttaatgatccaaaaattagagcggtacttgcatatgcagtgacagtttaaagggtaagtagttagcttgaatttccgaactagggatgaatgaaggtgttagctggctttgcttttaagaaacaaaatgtgacagtagagatttaaatgatggttttggaacaaacataaacacagggtaaagaggccaaaagaccaaagctaacagctattttagttcagcaacatgcatttcacggccactatgatatgtctggcactaattccatacatatccagcaattcctcggacttcccactctggggcactcccgacactgccagcgaatgaacctgaatgtcaggatccatggagacggctgcgcagacagcttccccgatgccacctggggaaacaaggatgttaggcccttttgtgaaagcagctcgtcagccttaaagcctcaccacatagaggcctttgaatctgcagcttcccaggggaaaatctgattcatgtgaacagccactccgatgggcctgcggagttctcattctaaactgccagtttccaaactgctctgcctcaacctacagtaagggctgcctgagtgtgggggtctgtggcactctgattctcaaagctgttggggacctgaaaatggttagaactaatgaattaacagtgcagaaaagtgactagctggcttgaggctgttggttggcaaggttagctcttggctcgtgaaggttcccttgctactctaacactttccccactagacagggcggtcatgcacctggactgtctgtaggaacaatgtggttgacatgagcacctgctttcctgctgggagccagggatttgggtacctgcctggcagagggtgccaacaggacctgcccccagtacacacttgaggtgccaagtctctagcaggcatcccttaggcaggaacacagcctgcgtgggaggcacttctcagtatgccccttgtggggccaaggggaggctggggcaggacttctttcaactccacctggcccatggttcctgccctggtggatccccccctgcaccctttccctgtcatcaacctcaggtgtgagagcaactgtgtgctgggtcccaggagtccttcgagagatcaggcaccgcttgtgcaggctcagagggcccctgccgcatgaacactcaatgctccttgtatcacatcatctgtcccacctaacctttccaggcgcaaacactgcccagcccattctccctgacacactgttttctgcatttgctgtgttctctgctatacctgctttcgtcggggcacactttttttttttttttttttttttttttttttttttttttttttttttttttgaggcagagtctcactctgtttcccaagctggagtgcaatggtatgatcctggctcactgcaacctccacctcctgggttcaagtgattctcctgcctcaacctcccaagtagctgggactacaggcatgcaccaccacacccagctaatttttgtatttttagtagagatggggtttcaccatgttgaccaggctggtcttgagcttctggcctcaagtgatctctacctgcctcggcctcccaaagtgctgggatgacaggtgtaagccaccacgcctggcctggggcatactattcatcattccaaacccaaagaaactgcgatgcttttcatgacacctcgcttgcctgcaatagccactcctctgtgttgccactgacccgccctggtgactgggcactgtgcactctgttggggacacacagatgtgtatgagtatggccccacgcttagtgaacatcaaataacaaagccatgctgggtgagaggtagactataggtgatgcctgagagcatgccatgtggccaatcaaggaaacaaaaacaccaaaaccttccaaagcattctcaatgcccacacacaccttgcgggtagtgatcctccactgtaatgatccggccctctgtggcttttgcactggagacgatggtggcgacatccagaggtttaatggtaaacaggtcgatgacacggataaaaatatctgcagaacagcaaaaaccagcttggtacaagaaagagactcagaataacatgcagggataaaaataaaaagagcactcagggcacaggaggtagctgaagtcctacctcttcccagcttgaacttcaatgctcatactcaaccaactgaccttgtttcgaaagctcatcagcagctgctaaggcttcatacacagtaattccagctccaataactgtgaccttgtcactgacacagtggcggaggacctggtatagtgccagcaaaacagaatgccgtggttactacacacagaatgcatgtcaaagtggaaggcactttgctatgccgctatcccccaattctaacaatttcactccttaataactcactactaaaaaaatcagatgcatttacaagccaggacacatactttttgataggaaattacactgctccagctgtcctggagcatggatacgccacatacccatcaggagtctggtttgagagctcactatggcatgcaaagattggactccagtgactaacatgttaatgagaacattctgggcattggcaacacgctgagtgctaagatcttgtgtgcctgaactctgagaaccctcacagcctccctgtaagatctgttcagtggcacaaccgttctgcagctgaggaaagcaaatctcagagcaggaggaagtggcccagggcagggctgggacccacagccaggcggggctgacatcaaagccctcgctctcgacaacgtactattctgcaagcaaagacagagttcctgggcttctttcatagattgttgcctccaaagctacccatcggaggcatctggaattattctccacttcccctctgtataggtttccctgtagcttaagaaccattgctgatagtacagaaagggtttctgagccaccccattctttaaggatgtcctggcctcttaaaatacttatacacgcatgcacacatatccatgtcctcttttcaaagcccagccctttaacgatccatgccatgcatgttatcacacacatttatctcacatcctttactatcagtaaatttacttgcttttgtcaggacaggaaaattattagaaaagagacgacagaaataagcaagctctgcaaaccatgtgaatgtcaagagaccctccccatagaaacagaacctgtagttaacaccaaaggtgaacactaacttttccatttggtggcgttttccagctacgttatggcacacagtggacagttctggaaacacctgctttatggcagcactctggccattctgagtacttgcaactgtgaattctggagcagcctagtccttagcaaccaaattggatgttacctgctgctctttcaagagtggctatgggcaaacctttctattcagtatgatctcaactgtgtaaaatatacatgtatgcctagaacaaagacaggaaggaagcatgccaaaatgtctacaagccccactccctaggtgatgagcagagtcacttattttctccatagacgtttctgcttttctctatgcatggccctgacaggcaggctgagcaggggatggtcagcgtggtgggcagacctggggagactgggctcactactcaggcctggattctggtcttggtactcacaagctgtaaacccttaagtaagacacttactttctccaatcctcatctacagataggactgataatctgaacttctcagggcttttgtgagaataccagagatcatgttcccttttattcctggccttagatctgtaaaatctgaacctaacagattattcatttcaagtgatttctattattttttgtcttgtttttagagatagggtcttactcttgtcacccaggctggagtacagtggtgtgatccatcatagctcactgctgccttgaattcctgcgctcctctatcctccttcctcagcctcctgagtagctgagaccacaggtggatgccaccacacccggctagtttaaaaaatttttgtaaagatgggaatctcgctatgtttcccaggctgctctggaattcctggcctcaagcaatcttcccgccttggcctcccaaagcgctggcttctgttttgtttagcttgcggccaagataaattatagccacgaccgctcaagtggcttcatgttactatctttgaactcaacaacaacaaaagactccatttggaaagcagaaaagttcaggctaagctgaaattcatagaatgttccttcccaaggaaaagcaggtaaaggtcacaactgttttttaaaaaaatgagagcaaagaaaggatgatgtctcaactctgaagatagctggtgatagattcagaagtgttctttttacaggagatgatactgaataacgcaggagcgcgtaagcccttaccttggcctgtccgatctcaaagcgttcttgtggggtgtaaataaccatagtttctggtcgggtggtccgaatgaagcacatcccctagggcataaatggagccatggtttagaaaagcaaacaatgaatttccaacaacagacgttgaaagaagtgaaggaggggtgtgaagaggacagctctttctactaaaaacacaggctttggagaaaggggtgagcatctacaaccagtggacgacaggtcccagcaggaccttggggctgccctgaaggacaagctcccccatgccatcacaccaatccccttggaagattccccaatactcactgacttgttctgtgcagacagaacattaactcacggcaggagcactgactcacattgactagaaagcccgaatagaatgttaaaacattaacttttgccacaataacttgtaatgcttcatccttagaaagaccataaacatctatctgaatacaagacgactggcccctttcccaataaaatgtaaatacatttttatgaccaatttgagcacataaacatttaccagtataaatgaacacttgtatgtctaaagtatttgttaatttacatacatattaatggatgcattataaacgaatatagcaagaaacgtcgctactgttcgttcatacgctatgatccatctttattcagtgtcttcaccgaggcataactcagctgcagtgaaatgcatacatcctaagttcagcccttcctgaatgctgcatccgccgtggagccctcatccaagcccagcagcgcttccgccagcagagttcccttgtgcctccttccagtcagtctccccccactatgaagcaacctctactctaatttctatcacctaatcttgttttgcgcctctcttgacctttctagaaatgaaaccctataacgtgtgaaatcacagaacaatctccaagataaactaattttaaaagtacacaattggccaggtgcggtggctcatgcctataatccctgcactttgggaggccaaggtgggtggatcacttgaggccaggagttttgcgactagcctggccaacatggcgaaaccctgtctctccccaaaaatacaaaaattagccggccgtggtggagtgcacctctagtcgcagctactcaggaggctgaggcaggagaatctgggaggcggaggctgcagtgagccgagattgtgccactgcactccagcctgggcgacagagtgagactctgtctccaaagaaaaaaaacccaaaaaacaaaacacaaaaaccacacaaaaaagtacctaataatatgtaaagcgggagcccacttataaaaaaaaaaatcaaagaaacgcccatgagtgcttggaaagggaacatacagtccccatcccgactgtgccaggggttacctgtgtggcgcatgggcgaggtccagggtggcaagggaaacctgctgaacgttagtgggaaaggctggaaagatcaagaccacactgcctcgtctcccgtgcagctaggttctgaacaggaatttgattctgtccatctgatgcccttgcatgaggtcccacacactcttggcgccctaagctgttccaaaggcaagccagggccagggaacccgggttcgtttgtagtggtagcctaccacccgctctccagcttcctggatgtcaggacacagcaggagcttcttggcctctggctgcagccactggagactaacactatagtctgggactctgcctgaagcttgctcctgcggcttcttaagcaccctttgttaaacaccttctcctgtttacaacacccagaatggtccctgtttcttctgctaaaccctgactgagacaggctgtcaggttttgttcagtatcctgtactgttggactcttttacaaggcaaatgtgtttgtgtgcataatctcctgttttttttgtaaagaattctatcaccaaattttctataatgaatatcacttttatgttgagaaaaaaaagtccaatcatcagtatgaaactagcagagtccagaagcattttctgtctgaaactagtgtccccttaaaaataccttggcattggctgccagagcaacagcatgctccgtggagacggcatcagttgggtagaagatcgtgcacttgggaatggttcggaacatggctatatcctccagggccatctgggaagcaccatcgtcacctgagagaaccagagcccgatgaaaacaggagcataaccccattaggaacctgccctccacccacttctagctctgaagaagcaattattcctattgccacggggtgtcccgagctgtagcagagccccataaatggtcccgctgcatcctcacaactcatttacattgtgttcttgcacgcctgtctcccttgagatcacactgtgacacctcgggttagtcaactgaaaagtctcagctgacttttcagatggatcactccaagttactgtccacgatggctgagcattggtggcctgagtttggcctgctaagtctctgaacccgttctctttaggaaggtcctcaggctttgttctcccttttctgctctatcttttctatatccagagaccgggttttgcataccaaagtggtctttttcatttctccaggccttccaagtagttaacacaccttcaaagcatgctgagggtgctacagggtactttagggtgtatctgggaacgtagtttctcaccagaaatgtgaaagagaaatcttaatgtgcactgggcagcttagcttttctcagctaggaaggggattgtcaccatgcacactgccttgcctaggaccactgtctaacctcaacagcccagctctttttttaaaaaaattaactattattattttgagacagagtctcgctctgttgcccaggcttgagcgcactaggtcatcttggctcaccgcagcctctacctcccaggttcaagcaattctcctgcctcagcctcccaagtagctgggattacagtcatgtgccaacatgtctggctaagttttgtatttttagtagagatggggtttcaccatattggtcaggctggtctcaaactcctgaccacagatgatccacctgcctcggcctcccaaaatgctgggattacaggtgtgagccaccgctctggcttttttttttttttttttttttgacaaagcctctctctgtcgccaggctggagtgcagtggtgtgatcttggctcactgcagcctctgcctcctgggttcaagcaattctcctgtctcagcgtcctgagtagctggaatacaggtgcgtgccaccacacctggctaatttttctattttcagtagagatggggtttcaccaagtgctgggattacaggcatgagccactgcgcccagccttccagttcttctttggatggaacctagagtcactttctccatgtgactatttcaaaactgaaactgagcacagccacaggtgggctcaaggaccctttcctaggcccctctgcccctgcaacactgccgcgcctcctctctctggccaccacctgtgcctccagcttcacccagacagccgtgactctagctccatctagagccatctcgtccagcctcattctcccagggagtccctgagatggctttccagcgtgcatctctggcattctagaagcaagtgtgtgcagccacatctagtaagcccatctgcctgccacaggacgccagctggctcatctttcccatgtcatttctgtcattcacgaaaatgactctctgacgtttcccaagtgaggaatcccggagactcgtgtgttttgctcttcacgccattgcagagtgctccatctgttaggcacactcacctctttcttcactctcaggtccccccccacccccctggttttctcccccaccaccttgcacaccttgtttcaatcccctctctggcttcccgtttcctgtggtttccttctagcccacctgccaggtgactactactctgagaagggtgtgtttgtaagagttcctgcctcgtgtcacgctccagggttctcgctgccccaggcaggaaggtggtgatggtggtcccagcccccctcccacctgagcaggctgtgcagccagccagaatgctcctcgtcctctgtgatgctgttcaccctcagttagactgcaaccacagcgagggcagaaaaggctccatgactctgccagtcctgtccataacctgcacgcagctcaacacacaaggggcactcgggataagcaactgtttctcactgtctgaaacaacagtaccaccgagagatgcacttcaaaagttgccctgagagtctgacacttttaaagtacaatatggctttttcaagaaaaaggcttgaataatcaaacttcatggaaccataaggaaattcgtggtttaaccaatcacatgctaatctttctctgtgaaggaggaaggctaccaagatgatggcatttagaacccttaccaacagataccccacagtgggaaccaataatgttgatgttgctctcagcgaggcctcctatccggatgtgatcaaatgctcgagtcagaaaggcagcaaaggtgctagcaaaagcaatggtccgtccacgggaggcacagcccagagccacgctcacctgcagcacagagaacatgaatcagaacatccctgggcattgcccccaccgccccttctcccacagtccccatgataactcccattctgcacctgctgaactgctctgaagttctagcatgcgtccttcccacacccctctttcctcaaaccctgggcacccgtccgtccctcctgctcagacggcgccctcaactcatagctcctagggagcaagagatgagactctcttgcctgccctcctggtgtccgcagctttccagggtccatgccccgacaggacatcctgaatctgtcctgttcctgctttctcacaggggtctccagccatgcagctcctcctcccctcttgtgctacttccctttctcttggatcattctatttccattcaggtgtgcgccagcaccttttatcttcacagccccatctccgccttgtcctgcttttacatctgtgttctccttcgcagcaaacttctcaaaacttgcctatagtcattgcccctgctttctcattttccacgctcttcccagcctacttcatctaggccaccatccccacaagggacctcgaagccacaaaaccaagaggctgcctgaccttgggtggcctgtgacttgacttggcccctgatctcaaggcatttcctcctctcggtttctgcagtgtggcagtggcccactgctgtcgcctcatgggcgctgctggggcaagtcctcagggccctgtgcaccctcgggaagtcgcatctggcccaatgctcccctgatgtgcattctggtaatgatccccactttacattgccattccttaccccccttccccagaagtccgggctcaaataccccagaaggcttcaaactagaatacaaacctctctgcggatacacacaggctttccaaaggggatgtggctgtgggtgttacactcaagatcccaaactccagatcaactctgtctacattcatctgccaaaaggagggtctgtgctcccctcatggtctttttttttttttttagacagggtcttgctctgttgcccaggctggggtgcactggtgcaatcttggctcactgcaacctccacctcctgggttcaagcgattctcctgtctctgcctcccgagtagctgggattacaggcacccgccaccacgtctggctaatttttgtatttttagtagggacgaggtttcaccatattggtcaggctggtctcgaactgacaggtgatccacccacctcggccggcctcccaaagttctgggattacgggcgtgagccactgcccctgggtctcccaactgtctcttttaacaatcaccttctagcaacctgatccccaaagggcatgctctcagccacctgactcttacagggggatcatcctggagtgcagaacctccagacccaagtaaagaggacaatttgaaataactatgctggtggagagaaagtgaagaacttaattaatgaaactgtcaactctgtaaataacttttataaacaactttacatgaaagatcactatgtgattttttgacttacaactgggaaggaattcaaagaactgagtgacattcctctaacaaaacttcccttcccatctacttattcatgtaagtaaggtttcatagcacatcatgaagatgaaaaacaggaatagaatctgttctcaatgctatcacattcaaactacaagtatactcatccactaacataccagctaataataatcaaaattctatctcagtccagaaaaaaaaacctaatgctcagaagcctatattataattttttaaaaacctatcaatttatatgcatatttttgttgcagagaaaaatgataggacaatcaataaaaggctttcatgcataaagatatattggggaaatgaatggaatggaaattggaaatcaagtagaaaaagggttttaatttctgacaaagaaaagtggcttggcatgaattttttttttttaattacagaccaggtctcactatgttgttcaggctggtcttgaacttttttttttttttttttttttgagacggaggctcgctctgtcgcccaggctggactgcagtggcgcaatctcagctcactgcaagctctgcctcccgggttcacgccattctcctgcctcagcctcccgagtagctgggactacaggcacccaccaccacgcccggctaattttttttttttttgtatttttagtagagaaggggtttcaccatgttagccaggatggtctccatctcctgacctcgtgatccgtccgcctcggcctcccaaagtgctgggattacaggcgtgagccaccgcacccggcctggtcttgaactcttgaactccagcaatcctccagcttcagcctcccaaagtgccgggattacaggtgtgagccactatgcccagccagtgtcatcattaatggcatgatttgagtattaaagtatcaaaaatgtcaatatatgaacaactacatcctttgcaacgacttaaatttatgattaaaaatgtagatgtggccaagcatggcggctcccagctcctcaagaggccgaggccagaggaccccctgagcccaggagtttgaggctgcagggagccatgattgtgccactgcattccagcctgggtgacagagcaagactccatctctacaaaaaataaaaataaaaaaaagatgttagcttaaaactaggccaacgaatatgtagtttagaaaactgcatttagtggtgtggagcggccacatgtgaaaatgactgactgatctactgcccagccatctgataccactgtctcccctctgtacatctaacaggtgccccaaccccccaggcccacacagagctcctgatggtgccccccagtccacttctcccccagtcttgtcaatctcaagaggtgacaccaccttcccccaggtgctgccacccacactcaagcaccagccttgggtcctgtcctgacacctgccgttggatcctgctggctctcctgccaaggcaatatgtgacaagtctgcttccctccgactccacagctactgccctggtccaagtcaccctctccttctcctccctttcctacgtgaagccattctccagtcttcagagttttggaaaacgcaggctgttgctttcctgcttaaagccctccagtggcttcccagcaaactgcaagagaaccagagatactgaaaagggcgcctataagaccccgtatgacctgggccctggagagttttctgcgttcaccatgctcctaccacttggcccttcctctgctctccaaacattccaagcctgggcctgcctacagttggccatgccccttgcttgaaatgctgtctcccacatctgtacacggctgacccctcgtcacctgagactcagcttaagtatcaccttttctgagaggttgtccctgactgcccctggtcaagctctacattgtagccacctctttcaacatggcactaaataccacctgctcgccttttctttacaacttttttccaactgtgagaacatatcagcagggacggagtagactacatggctgcgtgctgaggcaatcagtgaggtggggagcaaaatttttgacaggagcattaatccagaaaattacggatcgcattgttttctattcaaaatgaaaacagcttaatgagccaggctcgggggctcacacctgtaatcccagcactttgggaggctgaggcaggcagatcacctgaggtcaggagttggagaccagcctgaccaacatggtgaaaccctgtctccactaaaaacacaaaaattagccaggcatggtggcgcatgtctgtaatcccagctacctgcgaggctgaggcaagggaatcgcttgaacctgggaggcagaggttgcagtgagctgtgatcgtgccactgcactccagcctcggtgagagagagagagagactccatctcaaaaaaaaaaaacccccaaaaaaaaaccaaaaaccacaaaacaacaaaaaacccaaatggcccagcagagcatggggagctgtggggacacccatctcaacaggggtgctgtttggcttcagtcaactggcgtcaggagggaatgccaccctatggtagtagttcttcccatttttcaaaagaatccagaaatatgtattctatataagacctcctgattctttttcttttttgagatggggtctcgctgtttcacaggctggaatgcagtggtacattgcagcgtttaagtcctgggatcaagcatcctcctgccttagagtcccgagtagctgggactgcaggctggtgccactacacctataatctgatttttaaatgctggcaactaatttttaaaaaatttaaaatactggctgggcgcggtggctcatgtctgtaatcccagcactttgggaggccgaggcggacggatcacgaggtcaggagattgagaccactctggctaacacagtgaaaccccgtctctactaaaaaatacaaaaaattagccgggtgtggtggtgggcacctgtagtcctagctacttgggaggctgaggcaggagaatgtcgtgaacccaggaggcggagcttgcagtgagctgagcactccactccagcctgggcgacagagcgagacttcgtctaaaaaaattttttttaaaaatactacttgttataaataaagtcactggtggtcacataagacctgctggcctgtggttttctggcctaatgacaggagctgggcatcatcttctatgacgcgcagagctttagagttcaaagggtttactggccataactccttcctctccagaggggtgcgcttgtgtgcatgtgcttgagatactccctgcattaatatcactctggggagagactgaggcatagataagcagaatggctttgcctaaggcaccagctctaagcattgatattcttgtgattgaagtaagtgcaacatttgcatttctgtgctatattaggcccctctacagtggagagaaggaaactctgcattccctgtgactcctcagccagtgtgcctctgggtggttgcagaattgggcagaaggagctactagggagcctgggatgcttcaggcccagagccctgggttcagatggttcgaggctcagaggacccactgtctgtggccttgcctgctgccctcagccaacttggagactccaagtgccgagtagtctattacggccctcctagcagacctagaagccacctctcagactccacctggctacttgcctcctgcttcccaggaaatttttttccagtccttttgctttcataaatggaaagaaaaactagcacaggctgggcctcctgtgtccagtgggccattgattctaagaagccctgagagacactacacactcaccatgttttgttcagccataaagcactcgatgaagcgctcagggtactccttgttgaatatctcagagaaagtagagtacctggtgtcaccatccagcacaacgactctgttgttcgcgtagcccagcttagccagagccagaccgcatgctttccgagtagctatctagaagacagagacaatcaggtggtagagtttcttcaaatgcatttagaaggaacgactacagaaggaaggtaccatattgtagaatgacaaattatcatctatcttgaagaaagtaaattcgtgactcaccaaaaatttcctttaatgtcataaacatggactgctagccaatcttaaatccatactaaatggctgatgtggcacccaagtttttctcaaattgtgctctttttagttaacatcccccgctcccccaacccccacttcctaagcaggtaaacactccacagctcaagagtgagatttccgacattaatggttctcattatatttttcaaattacttggccaggtgtgctggctcacatctgtaatcccagcattttgggaggctgaggcaggtggaccacctgaggtcaggagttcgagaccagcctggctaacaaggtgaaaccccgtctctactaaaaatacaaaaattagctgggcatgatggcgggagcctgtaatcctagctacttgggaggctgaggcaggagaatcgcttgaatccgggggcagaggttgcagtgagccgagattgcaccactgcactccagcctgggtgactgagcgagactccatctcaaaaaaaaaatgttgagttttatgaattgcttttgtttagtgtgtatgatgatgatcacacttccctccttcctttaacctaacactagaacactgaattctattcctacatctcctggcatgagtcatctgcattactaatttgagctcactgattcatttaatttttttaatgtactaatgaagttgagatgggctaatgttctatttagaatttttatattggtattcataaagaaagttgctctgcagttttctttaggctagctttgtcacattttcgcttcataagtaaatcgggatgacattttcatcttcctccgtatttggaaaaatttgaaacagtttagaaattactcttttcataaaggttaaaaatgagtcagtcttatataacctggtgagcctggtgctttgggggtatagcacttggataattttctccatttttttctagggctattgatccatttaaggtttttatacctcttttagtcaattttgatattttatgtattcctaaaaatggtccccccgctttttacacattttcataccaattatgcaactatggagttatatagttttctcaaactttttttttttttttgagacagagtctcgctccgttgcccaggctggagtgcagtggcccaatcatagctcactatcccctcaaactcctggactcaggtgattctcctgcctcagcctccagagtacctggaaccatattatggcaccatgcctggataatttttaaattctatgtagagatggggtctcactactttgcccaggctagtgttgaactcctgggctcaagtggtcttcctgtcttggcctcctgatagtgctgggattacaggagtgagccactgtgcctgcccaccctttgttgatataccgtctcctttcttctggtttttgtcttttgatttctcaagtattcaaaattcatttatttttaaccctcattaccaggctaagaaaacatgagcaacactcaaaatttctccaaataaagaaggatcagaaagtgtgtccttcctccctaggctcgccgccttacttcctctaggccataaagaacttgcctatgtcaggtctgctatgatataccagaaggcaggatgtaaaggtgctaaaaaccaaaaggacttgatactcaagagttttgtgcatcatttgattcctttttgaggtttctgatgaattggcctgctcctctgtgtaattcagagagtaagttcaaaaggtcagcccgcctggggccagtcttcttagcggagacacagagtcgtggcagtttcatgcacaaaccaaagttaggaagctagaaaaaggcacaccacaccaggagctaataaatagcaattgaccaatcagaaaattcagacacacatgtgaaagccaaaaataaaaatcagacctaataaaagagaaggggagccaggagtggtgaaagatcaagtacctactgggtgcaatgtccactactccgatgctgggtgcactgaaagcccagacctcaccactacacagtatctatccacgtgacacagctgcactttggacccctaaatgtattttttaaaaatggcaaacctctctttattgcctacgaactgttagttacatgtcactctagtaattggttcgtccatggagaccagaataaatgaagaatcctgtgtacatacgaacaacattagagaacaaagcagttgacgtatctgatttattcaattatccacctttctgcctaccttgtcaccaactctgtaatcaggtggagaggtcatccttacatctgtgatgttgacttcaggtgagtcctcaatggggggctgtgggtcaagattcctgctggtctgtatctggctctcaattaatttgataatggcatctgctctttctctcggcattggctttgcatgccaactttctgcatcctcaatacctgtaatgaaacaaacaaaagacatccattccataaatatttagtgagtgcctatgaggtcacctgaaaaacagaccccgatgaaaaagatgtcaccctaggactcacaggaggaacacctggcacagagggcctgggacgctgctgcagccagagagaacagcttggacaaaggccctgaggctttttgttttgagacaggggtctcacgctatgactcctccccaagctggagtgcagtgggtgatcataactcaccacagcttccaactcctcgggctcgagtgatcctcccgcctccgcctcctaagtagctgggattacaggtgcaagccattgcacctagctatgcccctgagggccactggtgagtggaagggagaatgagaataaggctggagagacaggtagggcagaccatggagggtgggtcttgtgggtatgagaagtttgagttttatccaaagcaagattggaaaccattgaagggtttggagtggggaaagtgactgatcagatccactgtagaaagatcactgtggcagcagtgtagagactggtgtggagggaggccagctggaactttgggagagatgatgggtgtggcaacagtcatggtagtagagatggggaggagtgaatgggtccaagatgtaatctaggggactgggtctatgtgtgggcatatgagggggaggcagaggcaaggacaacacccagggtcctgccaggagcacactggtaaaataatttactgaacggagggtaccagagtaaaactatattttcggtaggagtcacagaacagttttattctaaaatgtctatagtcttttaaaaaaatccaggagccgcactctttgtgatgagttaaacctgagataaacaatttcagctgtcagccttgaaatgtgatagttggtgattccaagctcccgtcttccccaattcccagggttcttccagaagagtgtgggcctaggcacgtgtgtaggtatgcactcttatttcttgcacctgctcatacacacagcacgctttctgattctactaaccgtagagattgttccctgtcagtcctccgatgggctgtactcctagccactcccttgtgcaggcagcacatcactgttcacctgctagggcttttgatatctcctatcctaagcagacactagctagtgaaaataagagagcaggagcctccaacatatactccaggcagaactgctattcactaaatgagtcatctgcctaggcccctctaagcctctcccgcctctgctgctgagcggacagatgcttttaacaaccaggagcaggaggaaagtgcttgcttacttggggtgccccggcccttgaaggtcttggccaccacagcagtgggcttgtgcttcacctgagaagcctgccagaatacctggcacagtgcctccacgtcccggccgtccaccacataagtgttccacctgccaacagaggagcaggctgggttacaagagatgaagggggcaggacagaatggaaatcaagcacaagagaatacagttacccaaaggcttcgcagcgcctctgatagatgtttatgcagtgctcggcgggcaatgcaccactgtgtcccaggcggttcacatcaaagattgccacaagattgtccagactgtagtaggaagcaaaggccattgcctcccagacagagccttctgaggactcgccatcactcatgaggcagaacacccggtagctggagcaagacaagagaggtttaggaccctgtgggggatcatctgggccaaccaaacaaatgcatttcaggaggagaaacggacgcaactggagctgctgctccagaccattcgcttcccacaatctccctcatcaactctgccccagcccagcagctaagaaagccgagcttgaaaagcctgggggctcacaagcaggctttacctctggctagttttctgttctagctgtaaagcaacttttaggttcttctgccacatttccttatcaataagcaaacagggccagaggggaaggggaagaaagcagcatccttaagttccccaaacatttacacattcatttttctggtaagttcccttttaaagcattgccaccttctaatttttttgtttgtttgtttgaggcagagtttccatcacccaggctggagtgcagtggcgtgatcttggctcactgcaacctccacctcccgggttcaagcaattctcctgcctacagcccacgccaccatgcccagctagtttttgtattttttagtagagaggcggtttcgccatgttggccaggctggtctcgaactcctgacctcaggcgatccgcccacctcggcctcccaaagtgctgggattacaggcgtgagccaccgcctcccgccgccacctgctagttctgttcttacaacttatttacaataatcacaacaatcaaaacaccccaccttggaaacgtgttctgctgtgaagtaaattcctccacaaccaacgacgtgagtgttcgcatcaagaaaacacatctggccaggcacagtggctcacatctgtaatcccagcactttgggaggccaaggcaggtggatcacctgaggtcaggagtttgaaaccagcctggccaacatggcgaaaccccatctctaccaaaaatacaaaaattagctgggcatggtggtgcatgcctgtaatcccagctactcaggaggctgaggcaggagaatcacttgaaactgggaggcagaggttgcagtgagccgagatcatgccactgcactccagcctggccacagagtgagactcagtctcaaaaacaaaccacacatcccagaccccactaaagtgctggaagttttaaaaaagctatcaaccctaggataagaatggaaaggcaacagcagctgaaacctttcaacagacctgtgggagagaaagtggggcagccgcccgaggtggggaaaaggcacagggaaggccttccagaggggtcaccacgggatgtgatggggactggcccttcagggctctccacatcacggagataggtggctgccccccgagactctaggaaggggatgtagatgtagggcagttaaatggcttctggggaagaacctcacctggccctgtcgaagtacttgccagtatatgccattccacatgcaactcccagtccttgtccgagccatcctgttgccacatccacaaacgacagtctctgtaagagaagggacccagtgagcccagacgcagctgcaggacatggtatcaggtggactcacgcactgagtgcaggctgctcctgtcagctctgtagcagcgtcccatccgaacagcccctcccgccctgctgggtgaattcctcttccccacacccatatgcaccccaagcttccgatcaacgttacaagtggaaaatgggtcaagcccagggctcagcctgggctggaaactcaggtgactaaggtgacgaagacatccactgtccctgcccagggagtcataggtaatccatacagtatggcaagggtggctggagctttgggaatagagacggggagcccaagtacaaagcagaaaacgtaaagtatgattcttgacattttcccatggcccttcccggtcatgcacaaatcacatgttcaatcctatggaggatatggattcttaaaacagaaaccagaaagagaatactctggttccctggtttataaaactcaggtcaactgagatcttacacgtgctcatctagaagtgcccacgctagaaatgaatccctttctactagcatctaccccacccccaacatcctgtttgcaggcacagggtcatcactatcccaagcagaaaatgtggccctctgtgggccacaaggtcatgccaaagagctgctgcactgactggagaggcccaacttgcaagcatactgaatttacccaacagcttctgcagccaccatttcgacctggtcttaaacatcccttgcctctgtcactgcagtggcctcccagcctcccccacagccattctcaatctagccacaagggggagcctgttaaaactgaagttgactgatcacatcgctcaactttctaaggtcttccgacctcccaccaagtagagctcaactgtttgcacctgtctgcccaccccagcccccatcacctccatttctcccttccactgctctggcaccctggcctccttgctgctccttgaacacagtgggcatacacctgcctcagggccttagcactcatggcacccactaccggagtgcttgtgcgtggatgtgggcacagctcactctcctgcctcttccaaatccctgctcaagcgtcagcactgaggtctttctggaccactctttttcaaccagtgcctcctacctcctccacttttacttgattccagatgcttggccccacctgacactccatctattgacttaaaagtttgtttcctgcctgtcaccctcctctgctcaaacgtcagcgccattcgagcagagatgagcgaggtcatcactactgtagatggatggatggtatttacgattctctgatctcctgcttcttgcttcctaccctctgctactctctggttgctcttgaccttccccggaattctctgcatgctttgtgccccccagagactcccttttggttctgcatttccagcccagcagaactgccccactcaactcaagtctcttttgactatgcctctagccacatctccctccctatggcacccaccacactcacgtaacaagctctggctcccagtcgccttgcatgcccttggaagtcctataacataatggaccgagcctgggctcagcagtcagaccaactctgcttccctctggctgtgaagtgtgaggccagtgggcccatctcaaagactttatgggtgcaatggagaccagagcccccttaggtgacaggaggtcaaggataaagtgaggatagattgagaaaatggtgaggcatcagtatgatgcccgttatggcagaagtgctcccacatgggtgctgtctttctcaagaacccttatgctgcggggcagacgattcagggaggtgaaaggctagaataaagatctgctctgcctggagtatagctgtttaccccgttcccaggcaaaccacaatggactatgcttcatgtgttttctcttttgttccaatttcatcagccagctaaatctgatgaacacacaaattctggcagccgaacagggcctggtgtgctgctgcccgatagaaagcctcttcatcccctaaggccaatggctctgatagcagctgttatatgacagtctagatttttctttttttttgagacagggtcttgctctatctcccaaggctcaagtgatcctcccaccttagcctcctgagtagctgcaggcacgcaccaccacgcccagctaattttcgtattttttgtagacactggggtcttgctatgttgcccaggctggtctcaagagatcctcctgctggagcccccaaagcactggtgtgagccactgtacccagcctttccttattttaaaccagaaatctaaacacccatattgcgtttatatatctatttttttttcaattttcattgtaaagagggctggaagcggtggcttgttgcctgtaatcccagcactttgggaggcagaggtgggcgcttgggcccaggagtttgaggccagcctgggcaacatagtgagaccatgtctctacaaaaaatacaaaaattagccggtcgtagtggcacatgcctgtaatgccatctactcaagaggctgaaatgggaagatcgcttgaggccaggaggtcaggggtgcattgagctgagaccgagccactgcactcaagcctgggcaagagcgagactctacctccccaaaaaaagaacaaaaaaagatgtaaaaaaagttcaagtttatagacatgtttaaagcctagcacaatgatttccttcctgtatactgcttacctccaataaccaactgaaagcaatggaaggcatttacttcatccctctctccacacatgcgcgtacacatgtaaattctatttattttttgccaaaccatttgatgttatggttcagacaccaagacaagggtcacaattatgacctttaggcacttacttcagctatgcccagtttttgtcttcacttcccactgtgctaatctggcatttctatttggacacagtactctacccagccagatttttcttttgagatggagtcttgctctatcgcccaggctggagtgcagtggcacgatctcggctcactgtaacctctgcctcccagcttcaaacaattcttgtgcctcagcctcccgaaaagctgggattagaggcatgtgctaccatgcctagctaattttttttttttttaagtggagacggagttttgctatgttgaccaggctggtctcggactcctggcctccagtgatccacccacctcagtctcccaaagtgctgggagtacaggcgtgagccactgcacccggcccctagccaggttttaatttgcttcgggacacagtgtactttgagatggcatcaaaccagccacacattctcaaactgaccttgtttttaaggttctttttctttcctatcacccatgatacttcatgaagtggctggtattttgcccaatctcatgagaagtgcccatcagtttcaggtcagatgtgcagaaacatagaagaggaagctaactgacaggggtgggatgtccctcccggttacactcaagttcccccaggctcagtgagtgggattcactgaggctgcctgcctctcctcaggcagcacagagggtgggagcagcataaccctgccatgggggaagcgttcgtgctaagtggggcgaggcagggtgtgaccaaaggaaaggaaggacagtcagctctcccaagccacccttcctaccatgccatcacagggctccaagtggccctcactagaacactcgagctttaagatgcaaagaaagaagaaccaaaataataaacgaggcccatttcaggccttgttcccacacggtggctgttcaaactgggcttaaccagcaggcgccacagcagccctgggctccccaccggcatacctttgcgaggacaaatcggtcgttgtccggattctctggatctgactgcttgtacctcatgatgtagaagaacagcacagacatgatctcagaagaactgctacatgatgtagggtggctgaaagacagacatgacactggtcatttctcacagcaactggcttcctagcacacgacctcggcacatggtctcctcatagaagcggtcatttctcccagcccgggaagaatccaaccaagggtaaggaatgcagggctcacaggttggaagggcgctttaaagcccggtaagctcaccacccctccccctgtgcacagtgaggccagctcctaaccgcagagcaccgtggactcggggcaagtttcctttgtgcctctgacatgagtattctttcacatgcttaaattcatctgtggcctttccacatgccgaggaactttcaggagcattgtgaatcagaaatgccatgaagatcccattctaccttctacaatgaatttcttttaggaagtgaacggtgacagactgagaaatttgtcatggtagagtaactgaggccctttctgaatgctgccaaagtaactgctgctcttagaaagcggcctgcatgtgagtccagccaggccctaattaattaaaaagggggaggggacaagacagcaggggacaaaaccaactccctggagctctgccccaactgcaagtaaaaaaagatgttaggcccagctcatattaataatctctcatttcaaatttcactaagaaagtccccattaagaaaatggggactgtccctcccccattttcttaatggggacccgcgaagggatgggccctcactctgtcacccaggctggagtgcagtggcatgatcatagctcattgcagcctcgacctcctgggctcaagtgattctcccgcctcggcctcccaaggtgctgggattacaggcatgagccacgcacccagcctgataaaaaaaaagcttcaaaggacacaaaaagagggcttttgcacgtgcaattgtcgaaggtgactgatgaatggttttggggtgctgatggcagagcccaccaggctgcagggctggcgtggacattctcctgcagggctggcgtgcacattctccaggacccctcgttcacactcactgtcctggacatcttccctgcattgctgggataccttgttctttattcactaagctctttcctggctcagtgagagaaaactcaagaggccccggcagcagaggagtaacaggcttcagtggagaagggaccgagaaggaagtaattggaaatctcttcttcctctcaggttccatctcctctgctctctccccactgctgagggtcggtagaaaggggggtgacacactcccaccccatccttgtcacactgtgatctcccccaacgcatcagtgtctgcacctttgaggctccaaaaagacgatgtgccctttctactttggaaaatcacaattctcagaagaccaacagaaatgcatgtagaaaatgatggaagttactgggtatcagagaacacgatgacctgaatgagcaagaagatggtggggggcggggggtagggtggaagccagctaggactcggtagtgacaaatgcataactatttgcttattttcagtgccttttgcttcaagtgagaggtttctgctctcccatggtgaagtgtgaggcataaatcctgcttcattatgggggacttccaggggggtggcacgcagcccaggagtccccctggcatgatgagggggaagttgggaaaagagaagcagaaaagaaaatggaagggggccaaacgcaggaggtgtgaggaggaaagccaaggaagacgagggaagagggaatgataaaaaggagggagaggccaggcgtgggggctcacacctgtaatcccggctcttctggaggatgatgcaggaggattgcttgagcccaggagtttgagaccagcatgggcaacatggtgaaacctcgtctttccaaaaaaaaaaaaaaaaaaaaaaaaaaaaaaaattagctgggcagggtggcatgcacctgcagttcaagctacttgggaggctgaggtgggagggttgcttaagcccaggaggtcaaggctgtagtgagccatgatcacgccactgcacctctaggctgagcaacagagtgaaaccctgcctcaaaataaataaataaataaataaataaataaataaataaataaataaataaaaattttaaaaaatggggaatgagaggtagggtctaataagtagaaggcaaggtaggaggctggcgcaggaaacgagtcagggtgttattttgtgcgctaatgcaatgggttaacgcattcgtttcctaagcctgccagggtgagttgccacaaacgtgatggctcaaaacagaaatccagaatccaggtggcagcagggccacgctctctccctaggtcctaggggaggatcgccctcgcccctgcctctccagctactgctggccctaggtgttcttcgtcttgcagctgggtcactcccgtccctgcctctctgccttcacaggaccttttctcctgcgtttctccacggtgtctgtgtgtctccaatctctcttttctttctcttataaggacactagtcactggatttagggtccaccctaagtccaggatgatcttatctcaagatccttaacttaatttcacctacaaaaccctatttccaaataagatcacattcacaggtacgggaggccatggactgaatgtgtccccccagaattcctatgctgaaatcctaatgccagtgtgacagtatttggaggcagggcctttgggaggtgattacgctgtgagagtggagccctcatgaatgggatcagcgcctttatgagaagaggctggagaccgaccatgtgaggatacgggggggaaggtagtgctcttgagcccagtagcaggtcctcgccagaactgaccatgctagcaccttgatcttggatttgtagcctccagacagtgagagacgaatatctgctgtttaagccacccagtcttggcatttcttataacagccctaagtgataactgatttgggtgcccctattcaacccttgttttgacttagatgacattctctacagggaaaatttcttaggactattggacaaaatgtaaagttctcttcttgctttttgctttgttttgcaaaaaaaaaagaaagaggaatgggtcaaccagaacatctggaaagtctggagtatcactgaggaaacacagggcgattgagaacccgaaagtgaatggaaacctacgatagaagtgagatatgcttttctgttgtcacctcatcggactgtgtgtgatgacacaaatgccaatagccggcaaacagcgaggaaaccaacatgatcctgacagtttcaggagtgcccacgctgaatgatttttaagttgactatctgcctaaaataaataattgtctcatttaaaaaaaaaaaagaaaaaagaaaatggggacttaggccgggcacagtggctcatgcctgtaatcccagcatcttgggaggccgaggtgggcggatcacctgaggtcgggagttcgaaaccagcctgaccaacatggagaaaccccgtctctactaaaaaaaaaaaaaaaaagaaagaaaatggggactaaaacctcttgctttgcaaatgtcctgtaagtggatgatttagatttaaaagccacacagatcccttgagaaaatgcagccatctgttactaattttgaaggtgaagggaacaaaatgaacatgtacaaaaaattcagacatatatggttcttaactgcatccacactgtcctcttactatctagcccaggctctggagcaagatttatttatttattttttgagacacagtctcactctgttgcccaggctggagtacagtggcactctctcggctcactgcaacctccaccttccgggttcaagtgattttcctgcctcggcctcccaagtatctgggattacagaggtgcaccaccacgcccggctaatttttgcatttttagtagagacagggtttcaccatgttggccaagctggtctcaaactcctgacctcaggtgatccaccccacctcagcctcccaaagtgctgggattacaggcatgagccaccgcgcctggccaacaagatttaaaaaaacatattgcactaagtattttctctaaccacaatgggatgaggttagaaatcaataatagatggaaaactggaaaattcacaaatttgtgaaaattaagcaacacactcttacacaaccaaaagccaatggcgaaataaataaagggcatccaaattggagaagaggaagtcaaactagtgctgtaacactgatgatacgatcatacagctagaaaaccctaggccaggcgcggttggctcacatctgtaattccagcactttgggaggccgagatgggcagatcacctgaggttaggagttcaagaccagcctggccatggtctggtgaaactttgtctctaccaaaaatacaaaaatttgccgggtgcggtggcacacacctgtagtcccagctactcgggtaaggcaggagaatcgcttgaacccgggaggtggaggttgcagcgagccgagatcatgccactgcactccagcctgggtgacagaaactccatcaaaaacaagcaaacaaacaaacacaaacaaacaaaatcctaaagactcatccaaaagactcttagatctgatgaacaaattcagtagtctcaggttacaaaataaatgcacacaaatcagtagcactacaccaacaacgaccaagcttgagaatcaagaactcaatcccttttacaacagctgtaaacagcaaaaacaacaaataaaacccaccctaggaatatacttaaccaaggaggtgaaagacagctacaagaaaaactacaaaacactactgaaagacatcacagatgacacaaacaaagatatctcatgctcatggataggaagaatcaatattgtgaaaatggccatactgcccaaagcaatctacagattcaatgcaattcccatcaaaatacaccatcgggctgggcacggtggctcacgcctgtaatcccagcactttgggaggccaaggcaggcgatcaccaggtcaagagaccgagatcagcctggccaacatggtgaaaccccgtctctactaaaaatacaaaaattagctggcagtggtggcgtgtgcctgtagtcccagctactcgggaggctaaggcacgagaatcgcttgaacccggacagcagaggttgcagtgagccaacattgcgccactgccctccagcctgggcgacagagcaagactccgtctcaagacaaaaaaaaaaaaaaaaaatactaaaagtagtagattaccatctatctaccattcaatccagaaattccactactggctatctacccaaaggaaaaaaagtcattatatgaaaaaggtacatgcacacacatgtttataggcagcacaattcacaattgcaaagataaggaaccaacctaagtgtccatcaaccaatgagtggataaagaaggtggtgtatatacaacatggaatactgctcagccataaaaaacaatgtattttgcagcaacttgggtggagctggaggtcattattttaagcgaagtaactcaggaatagaaaaccaaatactgtatgttttcacttgtaagtggagctaagttttggagtgatataacggactttggggaggagaatgaagggggaaggtaggaaggaggtgagggataaaagactacatattggggacaatgtacactgcttgggtgatgggtacactaaaatctcagaattcaccaatatagaatttattcacataagcaaaaacaacttatacccctaacactattaaaattaaaaaaagaaaatgagaggctgggtgcggtggctcatgcctgtaatcccagcactttgggaagccgaggtgggcggatcacctgaggtcgggagtttgagaccagcctgaccaacatggagaaacaccgtctctactaaaaacacaaaattagctgggcgtggaggtgcatgcgtgtaatcccagctacttgggaggccgaggcaggagaattgcttgaacctgggaggcagaggttgtggtaagcctagattgtgccactgcactccagcctgggcaacaaaagcaaaactccgtctcaaaaaaaaaaaaaaaaaaaaaagaaagaaaaagaaaatgaaaaatcccttagagacaaatgaaaacagaagtacaaaataccaaaacctatgtgatgtagcaaaagcagtgccaagtgggacatttctagctgtaaacacattttttaaaacccctcacatctggccgggtgcggtggctcacacttgtaatcccagcactttgggagccgaagcgggcagatcacttgaggccaggggtctgaaaccaacctggccaacaaggagaaaccccatctctagcctgggcgacacagcaagactctgtctcaaaaaataataataaataaataacccttcaaatcaacaacctaactttacaacgtaaggactaaacccaaagctagcaggagaaaggaaataaaaaagatcaaagcacaaataaaacagagactaagaaaatagaaaaaatttaatgaaaccaatttttttttctttttgagacagggtctcagtttgtcacccaggctggagtgtagggcacaaacatggctcactgcagcctcaagcaatccttccgcctcagccttccgagtagctgagactacaggtgctcgccatgtctagctaattgttgtatttttggcagagacggggtttccccatgttgcccaggcttgtcctgaactcttgagctcaagtgatccagctgcctcggcctcctaaagtgctgaggttacaggcgtgagccacctcccctagccaaagctggttctttataaaaggtcaacaaaactagctattaatagatgggcagggcatggtggtgtgcacctgtagttccagctactcaagaggctgagaggaaggagagtcgcttgagcccacgagagttcgaggctgcagtgaactatgattgcaccactgcactccagcctgggtgaaagagcaagaccctgcttaaaaaaaaaaagtacaatcaagttaaagtggagtcattaataccgcttctacagaaataaaaagagtgacagtgtactatgaataactgcatgccaacaaatggactaacctacaagaaatggataaattcctagaaacagaaagcctcacaaaacttaatcaggacaagaaaatctgaatagacctacaactaactagtaaggagactaaagcagtaataaaaaaaacgcccaataaataaaagcctcattcgtaattactgccaaacatttaaagaaaaattaacaacagtcttcttcaaactcctcaaaaaaaaatttttttttctctacaaggtctcgcttcctctgttccccaggccgtagtggcacaatcttagttcactgcaaactctgtcccccgcgtagctgggactacaggcacgtgccaccacgcccagctaatttttgtaacattctgcacaggggattgccatcttgcccaggctgatctcgaactttctaggctcacacgatccgcctgctttggcctctcaaagtcctgggattacaggttggagccaccacgcccgacctctccaaaaaatttaaggtggaacactttgaaactcatcctatgaagccagcattacacttttgataccaaaagcaaatactacaacaaaactatagaccaggccaggcgcggtggctcacgcctgtaatcccagcactttgggaggccgaggcgggcggatcacgaggtcaggagatcgagaccatcctggctaacacggggaaaccccgtctccactaaaaaacagaaaaaattagccaggcgtggtggcgggcgcctgcagtcccagctactccggaggctgaggcaggagaatggcgtgaacccaggaggcggagcttgtagtgagccaaaatcgtgccactgcactccagcctgggcgacagtgatacttcgtctcaaaacaaaaaaagaaaaaaaaaacaaaaaaaacctgtagaccaatatcccttatactgatgcaaaaaccatcaaccgcatactagcaaattcaacagctcatttttgttccaattcgtactcaattcccggtttcttttactttatttttttagagacagggtctcactgtttgccaagctgaatgcgaactcctgggctcaagcgatcctccctcctcaggccccacgtactgagactgcaggcgtgagccaccgccctcagctgggtttaacttttttttctttgaggcacggtctcgctcttgcccaggctggagtgcggtggcgcaatctcagttcactgtaacctgagcctctcagcctcccgcgtagctgggactacaggcacgtgccaccacgcccagctaatttttgtaacattttgtacagaggttcgccatcttgcccaggctgatctcgaactagtttctaggctcacacgatccgtctgcctcggcctcccaaagtgcttgggattacaggtggcagccactacacccagccactccaaaaaatttaagatggaacactttgaaacatcctatgaagccagcattacactttgataccaaaaccaaatactacaatacaactagagaccaatatccctcaaactgatgcaaaaaccatcaactgcataccagcaaacccaacagcacaagcaagcctcccgaatagctgggagtgcaggtgtgcgcccccatgcccgactcattttttatttttattttttggtaagagacggggtttcgccatgttgcccaggctggaattttaattgctttttatcctcacatcctgggttagagtcgctcattcaccctcgggatccagtacaactgcttaccagggaagccctgctccccgctaaaatgaaaaccacagctagcccaatctgatcccagtgacattctcccgccacctcagtccagtctggatcctttgtctcccaactggagatcttggcgacctccagaactttggccgtgggtaaattgaggggcgggctccagaacccgcggctgaccaaccaaccgaccgacccttgggttggcgggaatagtgcctcgctgccatctagggtgctcgaccgggccccaacagcccaagacagggcattacgacacagcccattgtgcctctgaaggctctcccttcaccacacggcctcatggccaccaggcctgaagccaccgggcccgtggccctgcatgacccagacttcaatgaggagaacttacccggagctcgtggagcatgtggccctgatggaatggattcgcaagcggctggccatatcttgcaacacctgcaaggtgcccctgtcaggtctggcctcctccgggaactcagccctcgcctcagcatccgccattagtccaacccctttggagtctgaagacccactcctacgtctccggcgtctgaagagcgaatggcgcctgcgagctgcccagtgcgtttatgtgatgtcggtgcagctccctccgcatgcctcgtgccactccctccacctgccgctccctccgccggccgctccctccgcaagcaagtcaagggatctggaatgtttgtgacttgcatgtgcacagttattgaaaatagtcccattctcatcttctctcctgcaatctcaaaagggctccctccgcgcgggtgcagggtcttctttctctgcacaaaaagttccggcactagctgtgtggtgccgcacgtgtcagggggtggtgccgcacgtgtcagggggtggtgccgcacgtgtcagggggtggtgccgcacgtgtcagggggtggtgccgcacgtgtcagggggtggtgctgcacgtgggacgtgcagctgcaaccgtaaaggtgggggagggagggagctgctgtggcgcaattttttgtttcgtgataaatggtcacccctcccccacaacagcccaggctatggcgggcagggtgggggtggggcagtgctcagggttctgagacggttggcgcctgcgccagcctcctttccttttttaaaacattctatgaggcaagccccgtgtgattgttgaggaggagttagcccattgccagcctgtgacgtgactgactcgaatgaaccctggtaactagggaatgtgctcgccctgtgtctgaaatgccccatgtccggtggtgccagcactagcccccatgtcggtctcagagaaccttctccccacctctgaggtgacctaccgacccagaactcgcatggctcccaacggcgccagctccacagcgccgtgcccaagtccagacattccggatcccaagtgctgtctcttggttcaaaaatgccgaatttctacgtgagctcaagtcaggccgcctggtcgcgccacaggctgaatgcccttgggttcccatgttctgctgggttaaagggaatgtgtgtttacattttttttttttttgagacggagtctcgccctgtcgcccaagctggagtgcagtggctcgaacttagctcgttgcaacctctgcctcctggcttcaagcgattctcctgcctcagcctcctgaatagctgggattacaggcatccgccaccacacctggctaattttttgtatttttagtagagacgggttttcaccatgttggccaggttggtctcgaactcctgacctcaggtgatctgcccacctcggcctcccaaagtgttgggattacaggtgtgagccaccatgccaggcggtggtgggcacctgtaatcccagctaatgggaatctgaggcaggagaatcacttgaatccgggaagcgaggttgcagtgagctgagatggcgccactgtactccagcctgggcgacagagcaagactccgtctaaaaaaaaaaaaaaagtggctgggcacagtggcacacgctcctgtaatcccagcactttgggaggccaaggtgggtggatcacctgaggtcaggagttcctgaccagcctaacatggagacaccccgtttctactaaatacaaaaaaattagctgggtgtagtggcacatacctgtactcccagctacttgggaggctgagacaggagaatcgcttgtacctgggaggtcgaggttgcggtgagccaagatcgagccattgcactccagcctgggcaacaagagcaaaactctgtctcaagaaaaaaaatttaacaggccacctaattgcgattaaaaaaaaaccaaaaccctgaatctgtttagattcccacttgcagggtatgtgacatcaccttctgccacattctcgccagccctggacattgttaggctttttaatttttggcgttctggtggatgagaaaatagtatttaattgttgcttttcgcttactattcccggatcaccttgcaattacatgttttattatacgtttactgtcttttgtttttcgtcgtctgagatgtccgtggctaccctttaatgtctttatattgggttatttgctcttagtttactgatttgcagttctttatatattgtgttgattagccctttatctatcagatatgtttcaagcctttttttttcttgtttgcttttatttatttattttttgagatggggtctcagtctgccaccctggctggagggcagtggtgcgatcatggcagcctcgacatccccgggatcaagcgatcctcccgtctcagcgtcctgggtagctgggactacaggtgtgcaccaccactccaggataattgttgtattaattttttttttaatagagacggggtttcgccatgttgcccaggctggtcttgacctcctgagctcaagagatccacccaccttggcttccaaagtgctgggattacaggcatgagccagcacacccagcccttgtttttttttctccccctttctttctttcttttttgtttttgttttgattaatcaagtcccatttttttctcctcttggttatttggatgttatgtacatatgtagcttcttttctagtgattacttttttttttttttttgagacaatctcactcttgtcagtcaggctggagtgcagtggcgcagtctcggctcactgcaacctccgtctccccggctcaagcaattctcctgcctcagcctccccagtagctgggattacaggtgtgtgccaccatgcccggctaatttttgtatttttagtagggacagtgtttcgcagtgttgaccatgatggtctcaaactcctgacctcaagtgatccacccgccttggcttcccaaagtgctgggattacagctgtgagccaccacgcccggcccggccccccccccccgctcttttttttttgagacaaggtctcactctgtcacccaggttggagggcagtagcacagtcacaggtcactgcagcctctacttgctgggcacaagtaatcctcctgcctcagcatcctgagtagctgggaccacaggtgcacaccactgccctggcaagacttgctttttaaacagttgttgaattcttacatttgtcagtggtgtactgaactccttcatgtctaaaaatgtctttagtctaaccccacagttgacagttggggtgtagaattttaggctgggaaatcatttttccctcagaatttcgaaagcagcacttcattgtctttttttttttttttttttttttttttttgggacagagtcttgctctgtcgcccaggctggagtacaggggagtgatcctcggctcactgcaacctcttgggttcaagcgattctcttgcctcagcctcccgagtagctgggattacaggcgcccaccacaatgctggctaatttttgtatttttaagtagagacagagtttcctcatgttggccagcctggtctcaaactcttgacttcaagtgatccgcctgcctgggcttcccagagtgctgagattacaggtgtgagccaccgtgcccggccagcacttcattgtcttctagttccccatgctgttgctgaagtctgaagccattctgacttctgattctttgaatgtgacctatttttttctctctgacagttattctctcagtgtatcgaagatatcagtcaactatcttctggattgcattgatgctattgagaaggcagcctgcagtctaaaagtcatggttttaaaggtaatcagctttttttcctctggctgcttttaacatcttgtgtcggccgcggcggtggctcatgcttgtaatcccagcactttgggaggcccaggtgggcggaatcatttgaggtcaggagttccagaccagcctggccaacatggtgaaacactgtctctactaaaaatacaaaaattagctgggcatggtggcgggcgcctgtagtaccagctacttgggaggctgacgcaggagaatcgcttgaacccgggaggcagaggttgcagtgagccgagatcacgccactgtactccagcctgggcgacaagagcgaaacactgtttcaaaaaaaaaaaaaaaaaaaaaatctcgtgtctaggtgtggacctatttctgtcttccctgcttaggatttattgggcttcttgaatttgtgaatttgtgtctttcttcagttctggaaagttcttagggagttatctcttaaaatgttgctgctgtggccggtcgtagtgctcatgcctgtaatcccagcactttgggaggccgaggtgggtgggtcacctgatgttgagagttcgagaacagtcttgccaacatgatgaaaccccatctctactaaaaatacaaaagaattagctagctgtgatggcacgcgcctgtagtcccagctactcgggaggctgaggcacgagaagtgcttgaacccgggcagcagaggtcggccgtgagccgagattgtgccacggcactccgcctaggcaacagagtgtgactccatttcaatttaaaaaaaaaagaagaaaaatatgtatatattgctgctgcttcattctgtctgtcttctctctctggtgtgacaattggatttttgttagacctactcatgctaccttccatgtcttctatttttcaagttttctatttttttgtgcctctgtgctgcattctggatacttttttttctttctttcttttctctttctctctctctctctctctctctctctctctttctttcttgggatggagttttgctcttgttgcccaggttggagtgcagtggcgtgatctcggctcactgcaacctctgcctcctgggttcaagccattctcctgcctcagcctcccaagtagctgggattacaggtgcccaccaccatgcccagttaattttttgtattttttagtagagacagggtttcaccatgttggtcaggttagcctcaaactcctgacgtcaggtgatccacccgccttggcctcccaaaatgctgggattacaggcgtgtgagccaccgcgcccggcctggatactttctttagctcctctgtacaatttaccaacagtctctccagccatatcaaatctgccattaaatccatcaattgaacatattattatttattatttatttattttttgagacggagtctcactctaccacccaggctggagtgcagtggcacgatctcagctcactgcaacttctgcaccccgggttcaagcggttctcctgcctcagcctcccgagtagctgggactacaggcgtgtgcaccacgctggctaattttgtatttctagtagagatggggtttctctgtgttggtcaggctggtcttgaactccccgacctcaggtgatcccgcccgcctcggcctcccaaagtgctggaaagtacaggtgtgaaccactgtgccaggcatttttttttttttttttgtattttgtatagacggggtttcaccatgttggccagactggtcttgacctcctgacctccgcccgcctcggcctcccaaagtgctgggattacaggcatgagcaccacacctggcctatattgaacatttaaatagtttgaaaactgtgaaatctggcatatgtatataaaggtgcagaaaacattgatgtatgttttaagaagtaacgataaggtgaacacacatttaaccactactcaggccaggcaccccagcctccacagtcaccccagtcataatccccttctcccgctctagtgggaaccaccatcctggggtttctgttgccaacatccatgctgctctttagctttcctgcctgtgtagtcatccctacacaatattgtttagttttgcctgctcttggaatttatgtaaatggaaccatatatagtatggattttctgtctggtttcttttgttcaacattatgcttgtgaaatgcattcatgtttttcaaggctgtagttcattctcattgctgtacagtagtatgttgttgcatatattacagtttacttacactttctgggcaggtggtttgttgctagttgttggatattgagaacatcagtgtacttgcctcctgggaatatcgcctatgaatgcagttgctggatcatttggtaggtatatcttcaactttgtgatactgtcaagtggttttctaaggtggctgtagtacaaatttgcttcccgccagtaatgattgagagttcctgttgcgctatatccttgccaactcttattgttgttagtctgtctgagtttgaccaatctactgggtacatagtggtatcactttgcattttaaaaattgaggtataggccagatgcagtggctcacaccggtaatcccagcactctttgggaggccgaggcgggaggatcacttgaggtcaggagttggaaaccagcctggtcaacatggtgaaaccctgtctctactaataatacacgaattagctgggtgtggtgatgcacacctgtaatcccagctactcgggaggctgagccatgagaattgcttaaacccgggaggcgaaggttgtagtgagccgagattgcaccactgcactccagcctgggtgacagagtgagactccgtctcaaaaaacaaaaaagtagaaacggaacagaggctgcacctgagctgccccccacctccctctcctagctccttgctctggtgggctgggttccagctatgctgctcttgccatctttattttagaggtaagaaaactgagcctcagagcagtttattaacttgctcaaggtctcagagtggtagagccaggatttgaactgggctcttcgtcaaaggcaatgttaatcccctcaccatgtgagagactcattcttttgtgttacagtagaattttctgccgtagactgtcagctgtatgagatcaaggaatgtatctggcttctgtaccacgtggtaggcactcagagaaagtatgtgttgaatgaatgattggatgaatgaatgaacctgttaggaggcaaatctctctgcctaacccttcctgtctccctgggagtagcaatacagcaagctgtaagagttgacggaaataagcttattccatactttacaagaacagttctttataaatgagacccacaattggtaatttttggaagagaaaataggagtgcagtgcaaaaacaggcagatgtagaagggagtctggccacctgtgggtcttagtgaggcacacatgtagagcaaggagtcagacgctgaaaaggaggggagaggggccctgaagatgagcatcacctcctcagtctgtgtcgggcccatcttgaatgcacaaatcttgcgtgtgtaagtatccatgcatatgtggaagtgttttatggagtcataacgtgtccaattctcccacactttgcggctcacagagcaccgtattgtgatttcttgtttcccaacgtaggcggaacacaccaggagccccagcgcaaccctcccctccaatgtgccttcatgccggtccctgtcatccagcgaagacggccccagtggcccttccagcctcgcagatggaggcctagcccacaacttacaggatagtgtcaggcaccgcatcctctacctctcagagcagctgagagtggagaaggccagtcgggatggcaacactgtgagctacctcaagctggtatccaaagcagaccggcaccaggtgccgcacatccagcaggcctttgagaaggtgaaccagcgcgcctctgccaccatcgcccagatcgagcacaggctccaccagtgtcaccagcagctccaggagctggaggaaggctgcaggcccgagggcttactgctgatggcagaaagcgacccagccaactgcgagccacccagtgagaaggccctgctttcagagccccccgagccaggtggggaagacgggccggtcaacctgcctcatgccagcaggcccttcatcttggagagtcgcttccagagcttacagcaggggacgtgcttagagacagaggatgtggcccagcaacaaaacctgctgttgcagaaggtaaaggcagagctggaagaagccaagaggttccacatcagcctccaggagtcctatcacagcctaaaggagaggtctctgactgacctgcagctgttgctggagtcccttcaggaggagaagtgtaggtgaggccttggctctggggactggaagcagaggaggaaccgctcccaggagccacctatgggagggtgaaagggagccaggacaggagcctggagagccagggtgaggggccagttggaagagcaggtccatgcttcttttagcgactgggccctgcagtggggcgagccagccctctccctgcagtcccacacctgccttgacccttgctagcgaaaatgctccagcttggcagcccctgccgggtggttgcagcggcatagcggctggccctgaccctgtggtggcaggggacaacatgggggtggcaagagtccggtagacacctggcactagttagggaggtggcgtcctttggtcccagtcggctgggaaggtgggagtcaggaccggagtcgcctcgccagctctggtctcttcacatgtgctcctagctgagctggggcacaggccgggtctcagatacttatttcaaaaatgactgccttctggtgaatgctttctccgcaccgtgcagtagctcgattttctttttcttttttttcttttgagatggagtctcactctgtcgccagactggagtgcagtggcacgatctcggcccactgcaacctccacctcccgggttcaagcgattctcctgcctcagcctcccgagtagctgggaatacaggcgtgcaccagcacatccggctattttttgtatttttagtacaggcggggtttcaccatgttgaccaggatggtctcaatctattgacctcgtgatccgcctgcctcagcctcccagagtgccgggattactggtgtgagccacctcaccctgccctagctcgattttctttccctctaagataaggctagggcctaccaattggaggaaaaaaaaaaaaaaaaaaaaaaaggcaaacccaatctctcaacggattctctccattcctattgggaccgttctctgggtttccatgggccctcagggggtgccacattctgtccccctcgctgcagtctgtggctaattaacgccagtccctccagcgtcctggctagggaggcagcgattcccttaggtgagccaagattctcagcatttgcatgaaaagaagaactccgcagtccttttagtgcctgatgcaggggaagcggcgtgtgggaatcatcctctttagtttccccagggaaatcttgccagcgtttacatggcctaagaatctgttaaaggacaatcaaagaatattacagggcaaccactgtcaatgagatgactagtcagagtcacaggcgtctcttgcagattattttcataggacatggcaaccaaatctaaaatcttgggagcatcaaagacccttttgtgaaaatcacacttacccggtcagctttctattaagcaacagcagaacttggtggcagttacaaacttccccgtatgtttccaagccacaggggccaatgagaatgctgtgctcaggtaaactcttaacccctctcaaatccgagtctttcgcccgctcttgatacagcggtgactaccggggagcagggcaatacctctgtctctccccctctcagacttttgctgcaaattctagaagcctgcacttctgacccggtaccccccattggactgtgacatgggatgtctggttgtttgctgcagcagcgagcctacccttactaatgttcatcgtgagcagaaaagcaggtctacagggcccaagcaggtctacaggaggagaaagggctgctgatgatttttcactgttgtcacgggctcgtaactgagctggggcaccaggttaagcagccttgttctttggccctcagacgcctactttatggttggggaagcagagtctcacggaggcacaagcaggctacgtggctgctaagtgcggacctgagagcatttcaccacaccctggctgtgtggctaagttagatgcaggggacacaggagttcatggcattttaaaaacatatacttccgtaaaatcttcttcaaaacttttacatgatctggacacagaagtgtttcaaccagccaggctccctgtgactgttgcgtcccctctggtgcatcacaaactgagaatccatactgcaagtcctgtgctgtttatcacagttaaatccgtttgctttcaggagggctgttgtggtttttatcattatggtttctttttaatttggtctcggcatgtctctactgagagtggccatagccgagatacccagtttctaggagatccctgacccgtgggaaagttaggttcggatgtgtgtgtcaggggagccacagtgaggaggcagacgaaaatgcatgaaacagcagaaatgggctgggcgtgggggctcacgcctgtaatcctagcactttgggaggttgaggtgggcagactgcttgagctcaggagtttgagaccagcctgggcaacatagtgagacccggtatctacaaaaacatcaaaaaattagctgggcgtgatggcgcgtgcctgtagtcacagctactcaggaggctgagcgggagcggggatcccttgagcccgggaggttgaggctgcagtgagtcatgattgcaccactgcactccattctgggtgacagagcaagaccctgtgtcaaaaaaaaaaaaaaaaaaagaaatgtatgactcagatcgaagagatgttaggtgtgctgatgggaggcagaggggaagtctggaggcagcagggagctgattgagctcatcagctgtgcaacagcgaagcccagaacggaagggcggggaagcttccggggctgtgcctgtattaaggtcacagggtgtgaagtgatcccacaggctttcctgcgggggttgtggattggctggtttaaagaaaacatgcacgaggaggaaactgatttacatgactctggtgttgagcattaggtcttatcgtggtcagcagccgtgggatgtgttgggttttgggtcagtgaggcgaggaccacgtgggctatgtcgcaaacaatcacatgacagggagggaggggtgttatctagggcaaaggtgacagggtacaactgctaaagttggatgctgaggcagcaactgtattaaacgcatttatgacaagggcttacttaaaaaaattgatgtagaattcacataatttcacgtaatgtgaaattaaccatttggaagcatgtaattcagtgcattaagtacatctgcagtgtggttcaaccatcacctctgtccggttgtctaacattctcatcaccccagaaggagacctccagactcactacacggtcactcctagcctcggctccaggcgttccctaatctgctttctgtctccgtgggtttgcctcttctggacttttcatataaatgggaccatacgatatgtgggcttttgtgtctagctcctttcactgttttcaaggttcactaatgttgtagcacgtatcagtacttcattctcttgacggctgactaatattccagtgcatgggtagaccacattttgtttatctgtccatcagtggatggagatttgagttgtttccaccttttggctattgtgagaagccctgcgctgaacactcagatacatgccagttgtttgaacaccagttttcaattctttggggtctataatcaggagtagaattgctggaccccgtggtgactccaggtgtagcgtttagaggagtcttcccacagcagccgcgcagctccatcttcccaccagcaatgcagaaggcttccagttgcctcacatccttgccaacatttgttgttatcctttttttttttttccaacagatgtaactgtgaagtggtatctcattatgagggctggctttcttttttatttttcctgagtctttggataggcaaaagttctttctttctttctttctttctttcttctttttctttttctctctttctttccatctctctctctctctttctttctttttctttctctctttctctttcttcctttctctctgtctctctctctctctctctatctctctttctttctttctttttcttcagggtctctgttgcccaggctgcatgcagtcatagttcactacagccttgaactcctgggctcaagcgatcttcctgcctcagcctcccgagtagctgggagtacaaagcatgtgccaccatgcctggctaactttttaaaaattattattatttgtagagatgggatcttgctatgttgcccaggctggtcttgaacacctggccacggcctccccaagtactggggttacagatgtgagccactgtgcctggacagttcttactttttaatgcattttttaattgattgtggtaaaaacaaaaaacccacaatatattctttttgattctgcgaagtgcagggtctctatcacagcaacaattagactcaggaggcttggggctggccctggggtctcctccttcatgaggtctgggtttgtaggtccttgcagaggacgttcctgggtcctggaaggactgtgactgcttccgctggagttgcttgaggcccctggtaactctcctctctgtgtgctgaggagaagcacgggcgtcgcgaacttgatgattctggatggaagggtctttgccaagcttccctttctttcttgtggaaataggaggagcttcagatctccgagaagatgcacagtgagcggccgacctcctcagcacaagccagtctcctgggggaccagaaggccccggtccctcagtttcttcgtgggtcaggaggaaagaaggcttgagaaactcagaaaacgttcattggtagaagagatggcacccaaggaaggcatggggagccttcaagtaaaagtctcgactggccaggtctcatctgggcaccttgcatgcagagttgcaggaggccccctctagcctcctaatgagccagggggctctgggagggtcttgggggtccttccccatctcttacaggatgcgcagctgacttctgcttgatggtgaaaggcagtcaggtttcagtcttggccccgtagacagggcatggacaagtcctggagttgggggtatggtgccagcaaaaccatctttactctctggggtccatagccagtcccagcctgcccagccccaccctcctccttcacctttgtagcccgagtggtcaatgcctggggtagatgggttgctgggacatctttgttctttgttggatgagtaaaatggtcctgggagaaaacccgactgtgaggagcacattgcttcttttttttgtcttttttatgagatggagtctcactctgtcccccaggctggagtgcagtggcacgatctcggcccactgcaacctccacctccccggttcaagcgattctcctgcctcagcctcccgagtagctgggattacaggcacacgccagcatgcctggctactttttgtatttttcagtagagatggggtttcgccatgttgaccaggggtctcgaactcctgacctgaagcgatccacccacctcggcctcccaaagtgctggagttacaggtgtgagccaccacacctggctggaggacattgcttcttgccccatttctagttccctagacctgccttggcatcaactcattgaaggctccacttggtgacaaggaaccggcttatttggaaacagggtcgttgcggacgtgatgagttagatctggatgaggtcattctgcagaggggtgggccctaatgcagtgtgacctgtgtcctgacagaaaggggagacggagacacggacacacccagagggagagcgccgtgtggagacagaggctgaggccgacctgccgtggcagaagccaaggaagcccgcaggtgggcagcagagcagaagctgggacagaggccccgagtggaggcgccttctcggtcctcggcaggagcccgcccagcctgggccttcctctcggactgctggacccccagccaggagagaggccatctctgctgggaaagccactcaaagtttgtaacgctttgtgatggcagccagaggaaactcccacactcagcttgtcctttaggctctgctctgatgtcctctcctcaaagggacttcccaggctaccacgttcaaatggcctcttcttttattcttttggaagcggggttttttgaagtaaagtttttgtttttttgttttttttagatggagttttgctcttgttgcccagaccggagtgcaatggcgcaatctcggctcactgcaacctccgcctcctgagttcaagcgattctcctgcgtcagcctcccgagtagctgggattacaggcaggcaccaccacgcctggctaattttgtaattttagtagagatggggtttctccatgttggtcaggctggtctcgaactcctgtcctcaggcgatccacctgcctcggcctcccaaagtgctgggattacaggagtgagccaccgcgcctggcctttttgaggtaaattttatgcagtgaaattgcatttaagtttaggcatacagtttaacgagttttgacaaaggtttacacctgggcagctaaaatcccaataaagagctttgccaccaccccagaaagtaccctcataccctcttccagtgaatgcccgtctcccataattggccactgttccggtttctgtcactctagcttcatctccttttgaacttcacgtaagtggaatcgcacggcacgcagtgctttgtgtctggcggctttcgctccgtggaattgttttgagatccacccaagctgtgtgaagtgagtagctcatggcttcgtattgcttggcagccttccattgcatggagacgccgcaggttgcttatgccctggtccgctgccagttggggcgactgaataaagctgctatgaacgttctcgcacaagtctttctgtgaacatatgctttcatatatggaattgctagataacagggaagtgttatgtgtcttagtcccactttctgttgctgtaacagagtaccgcaggctgggtggtttataaagaaaggaagttcaatgtcaaggcgctggcagctggtgaggacctttgtacggcatcatcctatggcggaaggcagaagggcaagagggcgtgagagagcgagcgggggccaaactttcatgataacaatattaatattaatcgcctcttaccagtcccaccccttaacaccatcacatggccattaaatttcaacacgagttttgggggggacatgtacaccatagcagtatgcttaactttttaagaaagaggaaggccgggcgcggtggctcacccctgtaatcccagcactttgggaggctgaggcaggcggatcacctgaggtcgggagttcgagaccagcctgaacaacatggagtaaaccctgtctctactaaaaatacaaaattagcccggcgtggtggcacatgcctgtaatcccagctactcgggaggctgacgcaggagaatcgcttgaactcaggaggcggaggttgcggtgagccgagatcgtgccattgcactccagcctgggcaacgagtgaaactccatctcaaaaaaaaaaaaaagaggaactgttttccgacatggctataccattttacagtcccgctaggagtgtataagagttccagttgccaacgtttggcaagatcagtcttttaaatgtcagcctcttaagttcagccacaacttggtgaaattagactccaaaatttcatcaccctagcccatgttctctcgaccttggcactgtcgacattttggaccaaatgattctctgttgtgcggggctgtcctgtacattctaggatgatgagcagcatccctggtctccacttacttgatgccagtggtgccgtgaattaattgatgctgccgtgacaaattgcccccaacttcatggcttaaaataatagaaagttattctctcgcagtcctggaggctagaaggccgaaatccgtttcactgggctgaaatcaggcgaggaggacacacactcattggaggctctaggggacaaactgatctttgcctcttccagtttctggtggctgccaaattccttaattttgtggccacatcattcctgtcctgaaggccagcatcttcaaacctgtgttctgtcttcacatgacattctcgtctgtgtgtgtctaatgtccttctgcctctctctcatacatgtgattgcatttagggccaccaggataatctaggataatctttgcatctcaatacccttaaactcaccacttctggaaagcccccttttttggtcatagaaggtaacattcacagtttccaaggattatgacacagatatcttttgcggaggggctttttgtttttttcttttttagacagagtctctctctgtcacccaggctggagtgcagtggcacgatcttggctcactgcaacctccgcctcctgggttcaagcaattctcctgcctcagcctcccaagtagctgggactacaagcgcgtgccaccacacccagctaatttttttgtatttttcatagagacggggtttcaccctgttgctcagggtgttcttgaactcctgagcccaggtaatctgcccaccacagcctcacaaagtgctggggttacagatgtgagccaccgtgcccagcctaggggggcaattttagcctaccgtgccccacctatttgtaacaaccagaaatgtctgtccagagattgccaaatgtcccttgtttggggaggggggggccggcaaattgcccctggttgagaaccagtatcctagcccatgagactagtgggtgtgtgaccctgcctctgacaattaatgatgctgaaccccttttcatgtgcttatcagccaataagtctttggcttgttttcaacttggattgtctttttattgttgagttgtcagagctctttatatactccggaccagtctttgtcactcccctactttttcctttctcgcagcactcaccgcctaaactgctctcccttgtgtaggtattcatttgtgttgtattgttctcgtcaaaatatcagcacattcaggtcggccactgtgtctgagtgactgcccaaagacatgttggcacatgatggctgttctgtgagtacctgtttcatggatcagtctggatgctgcttttcctcccttcctgaagggacccagctcgccctctgggctgcctccctcctccatgtatgtcagaactctatctgctgtgtcttgggaacatcagggcagggccaggagggctgattctggatttaggcctggcccagcctcctctctgcaaggtatttactgaatgaccttggacgaggtgcttcaagtttgcaatcctcagtttccacatctgtaacatggaggtaaaaatgatcccactattgttggaactgttgtgagaattaattaatacttgtgtgtaagccccaagtagatgctgatggaactgaatttacaattcctttctgcttcctatgtgcaaactaagtccttgaaagatcgtaaagaaaaatggggccagatgtggtggcttatggctgtaatcccagtgctttgggaggtcgaggcaggaggattgcttcagcccaggagtctgagaccagcttgggtaacaaagtgagaccatatctctgcaaaaaattttaaaagtattaaccggacttggtggcacatgcctgtagtccctgctacatgggaggctgagacaggaggatcgcttgagcccgagagttttatgttgcagtgaactatgattgtgccactgtgctccagcctgggtgatagaggacagagtgagaacttgtctcaaaaaaaaaacagaaagagagagagagagagaggagagagagagagaggagagagagagagagagagagggagagagagagagagagagagagagaaagaaagagaaagaaagaaagaaagaaagaaagaaagaaagttgttaatggcttttttttttttttgaggtggtgtcttgctctgctgcccaggctggagggagtgcagtggcttgatctcagctcactgcaacctctgcgtcccggattcaagtgattctcctgtctcagcctcctgagtagctgagattacaggcatgcaccaccacgcccagctaatttttgcatattttagtagagacggggtttcatcatgttggccaggctggtctccaactcctaatctcaaatgatccacctgccttggcctcccaaagtgctgtgattacaggcgtgagccaccactcccggccaatgactcttgataaattcatcaatggagcaccctaggttgatgagctcagggatttggccaagatctcgacctgaccctgccttcctcttctttccctgagtcaatgcctcctgggtttgtcattcctgctgccctctcctctccacagcattacagtgctccactaccccttactctggttgtctgtcactttctagcagcttctctaggaccgtctccacatacctgatggtcttgtccatctctcattcataaattgctggtagaggttcagagataagaagctactcaagtcagaaagcagattggtggttaccagggactggggtgatggggaatggggagtgactgctaaatagtattttttcgaggcagtgatgaaaatgttttggaacaattttttttttttttttgagacggagtctcgttctgtcacccaggctggagtgcagtggcgtgatctcggctcactgcaagctccgcctcccgggttcacgccattctcctgcctcagcctcccgagtagctgggactacaggcgcgcaccaccacgcccggctaatttttgtatttttagtagagacggggtttcaccgtgttggccaggatggtctcgatctcctgacctcgtgatccgcccgcctcggcctcccaaagtgctgggattacaggcatgactgcagccggccaatgtcttggaactattaatagccatggtggttgcacaacaccacatgtgctaaatgccactgaattgttcaccttaaaataattcattttatgttacatgaaatttacctcaataaaaattgaataaaaaagaagctactcaggtgccgagtaggcaaaactttcactcttgctttgtatttctggctgtatccacaagtgggcagtcgtgaaattttcttatagcctcctgtcatattgaaaacgcccggaagtgaatatgccaggtctccatgtttttctttcccttctggacacgaggtccttgggggcatccagaccctagctcctctgtcccaagactgttctggtatgtttcgctttcagacgaggcttggagataacaggctatggttcctagaggcttcagtgttgctctgtgacctctcagccccagggatccagtctcgggctgactttcctcaaggtatctgcttagggctttgttgcaggctggggtcgtgttaacttgaaggcacaagaacttccattttttccccgacttctcctccatgtcacagcatcctgcatcttgggatctctgaggaggtctgacctaaggtctgatctgctctctgaactggttcctctcatccctattgcgttgaagcaaagcacagacattatatcagttcatctgtaaatatttcagtgtgaacctgaaatatggatcattttgttaacatagcctaaataccataccaaaaatgttttaaaacaagtccacaatgttaaatatgcagtcactgtcaccttattgcctcacacatgccatcattcctttttatttctgaaggaattcttttttttttttttttttgtgagacagagcctcaccctgtcacccaggttggagtgcaatggtgagatctcggctcgctgcaacctctgcctcccaggttcaagcgattcccctgcctcagcctcctcagtagctgggattacaggcatgtgccaccacgcccggctagtttttgtatttttagtagagacggggtttcaccatgttggccaggccggtcttgaactcctgacctcgtgatccgcctgcctcggcctcccaaagtgctgggattacaggcgtgagccaccacacccggccctgaaggatattttttgctggacatagaattctaagttggcacttaatttttggaaataataagcattttgaacaaatcattcccttctgacttccatggtttctgttgaaaaggcagctgccagtcttcttgttgctcctcggatcacagttttgttttcctcaggctccttttaagatcttttgtttttctttgttgtttagtggttttgctatgatgatgtttggcgtgattttctttctctcttcttttttgtgccgctgactctccccttggtgtgattttctttgcattcatcctgcttgggcttcgcattgctacttggggttatggcttgatgtcttttgtcagttttggacgttttcagccattatattttcaaatagtgactctgccctagtctctcatttttccccttctaaggccccagttacatgtatgttcaacctttccactgtatccctacatcctctgggttcctgtgtgagccgtcctggcgaatttcctcctgctttcgcttctgttttgttggctcttcccccagctccccagggccccttgctttggcacatttgctcagagtgagctcatccatcctggccacatgcaccgattgcacctgggctattgacccctcctacagctgtttctccgtctcagacttttcctccaagttgtgggccatgattaggctctagctcaatttgccaaaagcaaattctcagaaatgaccaagaatatactctttccggctgggcccaatggctcacacctgtaatcccagcactttgggaggccgaggcaggcgggtcacctgaggtcaggagttggagaccagcctggccaacatggtgaaaccctgtctctactaaaaatacaaaaaattagcccggcatgatggcgcatacctgtagtcccagctactcaggaggccgaggcaggaaaatcacttgaacccgggaggcggaggttgcagcaagccaagatcgtgccactgcactccagcctgggcaaacagaaggagatccgtctcaaaaaaaaaaaacaacaacactattttgaaaaaaacaataaagtttagaacactttgtgttggagagggtggtcttaacaccttcggtctgtcttgagggtgtctgggttgactggtcatcgttttgtgttcataagagcattctccagagttgtccatttgcttttgtgactgtaggaggtggagagaggggggtccttgaccaaggaagagaagggagcgcggctgccagagggccaggagatgggggccagagagaaggggagactgagagaatatccttatgaaaatattgtttactgacatctgaatagactcttcaagaatgcactgaagaatatcttcatgtatctttaccaatacattgatgaagattgacttcatattcctgaggacagttaaaatcttgaatgttctcacagctagatcattcatgtaaatggaaagacagtaatgaggaatctattttcggggtgaccatcctgccgacccactccccctctctgtgagcagtggcctagtccatgttgtccaccgactctcttcttaacagggacctggggcagagacaaatggaatattccttgaaatgctgcgaggaaccagcttttgacaaattggctttcaacaaatgagctgtcagcttattcagtgcccgggggatttctccgtgtgggtgttggtcaagtccttggagtgggaccgaatagaagtcgtcactgttttccccgtctctgtcagcaccaccgtttagacctcctgcacctgaggcctgccgccaccctcctgggcctcctggggcggcagccctgccagtctatgggttccatcacgctctggtgccttctctcttctacgtaagcggtggtgccagagccccctcactggccccctggcctctgtccttctggcccgttctttgtggtgccaaaaggggaacttcatagaagtttttaaattatgaagtatttcaagcaaagggaaaatgtaaggataacataattaacagccccagctttctgaaatcttaacatttgccatattcacttcaaatcttatttttttaggaaataaaactttaaaatattctgttgaagccctcattacccctttccagcaccatctcccttccttgctattctggccttgctatactggcctcaccattctcatttgggtgcttatcttttccatgcatggttttatacttttactacttatataattatatacacaacaggtagtgattgttttcttttagagatagggtctcactctgctgcccaggctggagtgcagtggcgtgatggcagctcactgcagcctcgaactcccggactcaagaggtcctcctgcctcagcctccagagtagctgagactacaggcgcgtgccaccacacccagataattaaaaattttttttgtagagacagggtctcactgtgttgcccaggctggtgttgaattcctcctggcctcaaacaatccccttgccttggcctcccaaagcgctgggattgcaactgtgaaccactgcgcctggcctgcttgtggttttttaacagctctattgagatataatttacatattataaaatgcaccattttaactacatttcaatggtttttagtaaatttactgagttgcgcaactattgccatgattcacttttctctttttgtttaaataacggctctattgagatataattcacatcccataaaattcaccaatttaaagtgtacaattcactggtttttcgtatagtcacagagttgttcaaccatcaccactatctaattccacaatattctcttttttttttttttgagacggagtctcgctctgtcgcccaggctggagtgcagtggtgtgaactctgctcaccgcaagctccgcctcccgggttcacgccattctcctgcctcagcctcccgagtagctgggactacaggcgtccgccaccacgcccggctaatttttttttgtatttttagtacagacggggtttcaccgtgtcagccaggatggtctcgatctcctgacctcatgatccgcccgccttggcctcccaaagtgctgggattacaggcgtgagccaccgtgcccggtcctacaatattttcaccagccccaaagcaaccctgtactcattagcagccactgcccatcccccacccccagcccctggcacccactaatctgctttctgtctctatggatttgcctattctggacatttcgtaactaatggaattgtactggaatctgtggtcttttgtggcttttcaatccttatagtcaccatgtttctatagagtaactgcaggctaaactgcaggctagacttcgtgctcaacactggtcctgggggatttgcggaactgaagagcacacacagatagttcacactgtcatttctacaacttctagtctgtggctatttttgtaaagctgttacaaaagagtaactacatataaaatatatatgaatattggtgtgcgtgtggctggtgtgtgtttggggtgttcccaggcagacctggagtgggaggcaggctttccctagagcctggggagcggggaggaaggcagaagctgaacccgaatctagtctaggtcaggaccgctcgctgttggcatgagctctggatgaggtactgaaggaatctcactttctcttttgctcccaaggcaagcattgatggaagaacaggtgaatggtcgcctgcagggacagctgaatgagatttacaacctcaaacacaatctggcctgcagcgaagagagaatggcctatctatcctatgagagagccaaggaaatatgggtgagaacctcctgggggagccttgcaagaagactggagggatgagcgaatctattctgatacccccaaaccaaagcaagacacgggtcctcgagctgccccctcctgagggttcgatggccacacacatttgtttcagagctagcagcatctgatctttacactcacgctccgcttcccaccatctggcttagctgcttttgccactctggtgctgcagtgctcacccgtgagcctctgactcgggagatctggggtggagctgcttctgctgcggctgcaggtgtagggagcgccctctcagaacccctccttagacctggcttccctctcctcacttttccattcccatagcgcccacccccgtccctgggtagctgtgtcttgaccaggtcctcagcttcgggagacagtggatgggggagtgcagccgggtcagatgaagctttccctgttgctggagagcctgcgccctcccctctgccctgaatgtgctctaggctctctgcttccctcctcgaatacccactccacagtgctttctgctcacccctaagaactcaataaacgaccacaactctgtgctgacttctggtgcgtgcattttcgtctcctgcaggagatcacggagaccttcaagagccgaatatccaagctggagatgctacagcaagtcacccaactggaggcagcggagcacctccaaagccgtcccccgcagatgttgttcaagttcctgagtccgcgcctctcactggcaaccgtcctcttggtctttgtctccaccttgtgtgcctgcccctcgtcactgatcagctcacgcctgtgcacctgcaccatgctgatgctgatcgggcttggggtcctggcctggcagaggtggcgcgccatccctgccacagactggcaggaatgggtcccctccaggtgtagactgtactccaaggactctgggcctccagcagatggaccttaaggggccaggagggccacctgccttagcttgctagctccctccctcctcctgggtgctgagggcatccagcaagcccctccacagctcttgcttgccgattatgtaaccaccagcctggtgaaatggatatagacgcccacctgcctcacacttctgttttgccaggatcctttcacgccatcggtagacatgaggctcgggaaaacttaaagtctatgaagcgctctctcctctttatcccccttgcaccctctcgagacccagtgcctgcacacgcagaggctcaggtcgtcccacactgcagtgaaagcctctgtgactttgttggttttggcaaagataaattacatttattttacagggatggagaaggagggggaaaggagaggtggccaaagccccggtgggcgggatgggtaggaggcagacctcatgcaggcgataccgaggacacagatgagacctccgttttggaggcgctggagagttcagagccatcgtcaaccttcttcccgaaaagctgcaagatgcagtttcgaaactggaaggacagaaagcgttattgagcagagcagggaagggtggagcactgtgctgaatgtacgtgcccgagccttcccttcacccattccgaatcccatgggggatggaggaaggcttggattatttctccctcacacgcggggatgtcatctgacttagcagttgatggtgactacactgggttgaagtgggtcccccaaaagatgtgttcaggttaagatgaggtcacactggagcagggtgggccctaatcgaatgactggtgtcctgataagaaaaggaacgcttggacacggacacgcagacagagggaagaaggccacgtgaagatgaaggcagagactggggtgacacaccttggagtcaaggaacgccaaagactgccggcagccctgcagctgcttctccctcccggcctccatagggaacctttccatttgccaacaccctgatttcagactcaagatttccagaaccctgagagaatccatttctgtggtttgaagccactgagtttgtggtagtttgtgacggcagccccatgacactcatccacagtgacagctaaggggcagtggtgacctgtccccagactgtctggtgagcggctcggaggaatattaatgaaaaggcatgtggttgtcatgttttttccagtccatggatctggggcaaggtgaggcctaggtaatgacaatctagcccctacctcatctctccagccaagcgtcttccggtaccaggaggggtctgtctttgctgcttcaccccaaagagatctgggccatatgaatgtctcaaatcatgtcctgtgtcatccctgaagtaaccacaatgctttgaggacccagaccaaaggcattttctaaatatttcaggcctactcttgactagctctaactccctctatcatcaaaactctcaaaaataaaaaatataatggttgaaattaataacataagaaacgggacaaacagcagaatcagctcggctgaagagctgggagatagggctgaggaatccattcagcagctgctgcttgagcacccactgtgtgccagactctgtcctgagcaaaatttgctgtcttcatggaactgcgttccagaaaattctctcagaatgtggcaggacaggataattatgtggaaagggtaaaagcaaagttcgaggcctggtgaggtccagaagtgcagacatctgtctccccctgtccagggggagttctggaaaggagaatggaaataatccagtaaagacagtacttggcaagatagtttaggattccagaaacctaaaaaagatcctcatgaaagtcaggaaacaggggtcagggatagaactacactctgggcatcagtgtgctacagcgagttcccggaaatccactgcaggcctggtcctacttactatttaaaagttaccagagagaatgaacccttaatgaactctgcagacttggcttgtgtgagtcaaagctgagccaaaggggctggagccattgagtggctctaagatggagaagcaaggaagagcccagtggaagggatggactgggcctggtgaaatgggaggcctctgcacacctttctggccaccatcaagtcacatcacagctgcgctttaatgaagcctgtaacctgcaggaggtggggggatttaggtgtgtgagcagcttgctgctgaggcccaatatgccagctaaggaggctgcctctgggcaggaccacagcacgtcccccctgaactaacccacaaactcgtgaaagctcttgaactcttggtcagtgtagccaaggagggccggcttttgttcttataggaagacaaattccagaggttacggtttgaaaatggagagatgaaggttgagaagggtcgagtctgaacagaagaggggcacacctagggtggatgtacctagggctcaccaactcctagagcgtctgaacgccaggagagcccctgaagctcggcagccatagttctagggccaccggaagggaagagcgcacggcacacagacgctttgggaaatgccaccctcaggccgagactataaaggattccagagggcacacctaagccttctgctaagggccagccggagctctggctggggctgggtcacacgctgagcctttcccggtcatttccctggagggtcccccagatgctccgcgggcttcttatcagagacatgattccaggtggggccatcgctgcacccttctagggcacacggtattttgagtgggatctgctgatggtgttgcttacctgccggttcataaagacatagataacggggttgtagatagtggcacttttggcaaagaaggccggcagggcagccatcaaagggtggaaggggtagccagggttggcagcagcaaagcatgcgaagaaggcgtagggtccccagcagaagcagaatgccaggaccatcaccaccaccatgcgcgtcacttccttctctgccttctgggtggattcagactctttctgctgctttgccacctaagggagacagggatagtgagtcgggggttggagggcagcaagaggcaggtgacccaggcatagggagttgtggggaggaggagaggagcccagcagccatcttccagccctgagtggagcacagccggccccaggcagacatggctgcctcaggctggccctgggggagttctagaattggaggtggcatgcagctaggtgtggcctaagatgaccccagagctggatctaacaagctcctttgcttcacctgatcccttaacagactgtcctgtcctgcgctcaggcctgagcatggaggcctgatttgattgatgactgggcgtggagaatgaaggagttaacaaggtggagatggcgggggaggcaaaagcagtggctggcggggtgcgcgatgggagtgtcagagcaatgcatacacttccctcaggcttcctaggccaggttggccactctgtggactaaatcctgccctggactcacggtgaggcagctgagggcagctttggtggggtggctccttcatgcctgctgggaggaaggagacgaatggcctccaggcagaggcactgtgggggaggccagaggccagccaccacctgccagggatgagggactggcggcaggcagatgagtggggatgagagagggagtgtgagggctggaatgcagggatggctgagacagcagagccggggccacattgtggagctggggctctaccatcccagactaatacagccgaagccatggttgggtacctgtgggagccttcaccccaaggtgacggggtgagggggcctttcacaggctcacagactcctctagagagagcttggcaggcatgcccatccaattgtgggcacaggcagcttcatataggaaagccagcaccctgaaagggctcccactgctaacagaaaagaaccagcctggctctcctcccttgctctgacttcctgaagggctcccagtggtagcctagtctaggggtggggggtgacggctgtggacaggatcagcttcccagggcagagggccagacatggaggtggagagtgggtcaggggggcaaatggcactctcgggtccactccttggtcggccccacagcctatgaaaaggacaagggtactccggtggcagcctcataaaaacacgccttgatttgcaggtgtcatttgctgatgtggctgctccactctactctgtgggaaaggcagcctttccaccccggggagaactgtccagggtcggggcaaggcacacctctgttcccttagtggactcctccagggagggagtggcagtgctttcccgtctcacagagctgaggacaacggggctggggctgaacctgcagccactggtacagtcccaaaggaatcacctgattctcatcgctggatcttaatattttcttataggggtaaaatcctcttctctaaggatttttggaaaaatagtttaggagtctcagtggactcatttgagggcagagcagcttaggggcaggaggcgggtgaggccaggaggaatcggggggcttaccgctcggatggccagccacacttggaggtagcagagcacgatgatgctgagtggggtgatgcagcaggtgaccatgaggacaatcatgtaagactgcaccccggggtacgagctgccgctgaacacgtctgggccgcatgaagtcttcaggccgtggggccagtacctggagagaagggccggcagccagtcctgatgcagggtggggtgacccaggacccccggcccaggcacggtgctaactcgggtggggtttgtttttttaaattgaggtgaaattcatgttgcatgagattacccaatttgaagtgatcaattctgtggcagtcaccacctctgcttccagaacattttcatcaacccaaaacaaaaccgttgggtaggattttggttaatccttgtccatttttagatgtcatgcctttcttctttttgaattgtggtaaaatacacatcacataaaatgtaccattataggccaggcacaatggctcacgcctatagtcccagcacatttggaggcagaggtaggaggattgctcgagcccaggagttcaagactagcctggatcacatagtgagatcttgtctctacaaaaaataaaaaaaattagctgggtgaagtggtgcacctgtaggcccagctcctcaggaggctgaggtaggaggatcacttgagcccaggaggtggaggctgcagtgagccataattacaccactgcactgtgccagcctgagtgacagagtgagaccctgtctcaaaaaaagaaaaaagtaccattgtgacctttggtacattcacaatgctgtgcaaccatctccactatctgcttccaggacattttcatcttcccaatcactccccttctttacaaagggattgtgaggttccttcttgccctgaccttctgagaacacccatgaagagctgagtcttttatctgaggtcagctaggccatgactgaaataaagggccctgctcacttagtggcctggaggattaaatgagataacccgcgggagagcctccaccagggtcagctcaccacacatgtttgataacgggcagctgtgtggggcatggcggcatgaggagggcgggagacagagacaggcttccacaaggtttgtttcctagaattgtggaacgttctcgaggaaagaacattccctctccaaacaccacgagaacttattcacgagcttgtcgataaaacagtgaaatgctgtcccacccagtccactccaatcaaacatttgagccacttgcttggcctggccaggacatgtgctctgtaggcccaggtggatctatgacccaagcagcctctgaaaggtggggggcgtggtgcggcagcgtgtgcaagaaagagacctggaatgcaaacacgctatgcgttcactgacagctgtgctgatggcctgagctccgtgtgcgcctgtgacctgatcgtgcttgggataaatatgtttccagaggttcggggaccacagagcctttcctatgttgcagccacattcatacattgatagacattgcacgctcagaggggcccagagaaaggaagtgatttgccttaaggtcacagagtctgaccctgcccactccatcttgcgtcctcgcacccttacctgctccaaccaaagatgggcggggctgtccacacagcagcccagatccaggagaaggcaatgcccacgatggccagcttggcatcaaatctcacattgccaaagggcttgcagaccaccatccatctctcccaggaaatgatggccagagaccagagacctgtgatccctatggggagagcagacagatgagggctttgagccaaagcaaaggtgggaagcaaagcttcccactgtcctgcttagaccccaaacgtctgcacacagaattcagggctccacggactgaggtggaaaaaacgacatctttctttccaccaacctcgaacagacactggaaatttccttccattatgaacgtggcagtattagcagtacccgtgactcggtcagcaagagaggtcacagatgttttcctgtcaattcatagaggtggcagagagttcgaataccacttatgttcatcactactctgaaataacagtggttgtcaggcgggatcctgttacttaataccttaatactgagtggtgtcactaatacgtttaacacatgcttttatttttatttactttttgagacagaatctcactctgttgcccaggctgagtgcagtggtgccatcatagctcactgcagccttgacctccagagctcaagcgatcctcccgcctgagcctcctgagtagctgggactactggtgtgccaccacgcccagctgtttttatttgttgtagagaagaggtctcactatgttgcccaggctggtctcaaactcttggaggcaagcagtcctcccacctcagcctcccaaagtgctgggattacaggtatgagcctggccagtaaatgcttttaactaaagactatgttactgatgaatgtttaatactttgataactgtatttcagtataatttgctgcctttgtaatcctatgggtctcattttatgcgtttgcaaaaattctcctgagatggggtccacaggcttcccagatggccaagggcatccgtggaccaaaagtggtggggaagtgctggctgcttggcacctgactgacccaagaacagaccatgagcagaggcaagggtgagcgggagaccatggcagaaacggagacagacgtgggcggagatgcaggggggcactcgggaagggtcgtgtgaccaccgaggccatgcctgctgcagagagcactcggacctggggatggaccttctctgcctgaccttcccttggctccccttctacactatcggggtagtgccgggacttggacaagcaccctctctggtctgggccatcgtgggtacaatttgaggcagttaacggggtggggttggggaggctgctaagagtggtggggaggcaagagcaggagctgctgctgctggatgtggggtctcctcctcctgaaagaaagtcccagctcctgggcatgacgtctgaggcctctgagacctgggcctgcccacctcgtgtccagcagccacggctgcttggtggtactctatccactcgaaccacaaactgctcccagccgctcctccaccacctgccccaggccccttcttgtctgagaggactgatgatggtactgtgtggttgccgtctggctatagggccccctccttagcacagagcctggcacgctagtacctctcggccactgtctcctgacctgagcggaatagtggcccacagagatattagtgatggggatggggagaggatctgggaattgtgtctcctccgggaaaagcagatgctggcgagctgaaagagcaggcatccctaattgcaggggagttctgtccagggtgcccagagtccccgcccccctactgttctggggttgtctagctctgtatctgtctcctcccacaccagccccacagctccaaactggctgtccccgggcagagcctgactcaagagtaggaactcagggtatgtttgactcaagggagctgaatttaatgtgagtgttcagatggaagcctccagaacccttcagtatatggatgtgaggcgcagatgtggagggagacaggcctacaggagcagctgggccccgatcatcatgaggtggccggaggggcttgcagggtgaatgagtggtttccgctgagcctgggccccgactggcttaccacacagggagacggtgtagccctccaggacacacatagggtggcccagcacgaagtagccatagacctggttcacaacgctgatagtgctggcgatgacggtctctgccaggtcagcgaccgccaggttcaccaggatccagttcagcgggtggcgcagcttcttgaacttcatggtggccgccagcacaagcccatttgtgaagacggatgcaatgaccacaaagatcatccagacactggtgaggtggtacacccatctgggagcgatgtggtaattcgggccttcgaaggggcctgagggcaggaggcagaggagagagaggagctgggctgcagcaccgcctgtctataccagtgctgatcccacctctcccctcccccttccgccctcctgcctttgcaattggctgtttccctccagctttgtccatcctcagacagtctcccctccatcctgtccctcaagccagagaccatcgcccgctggtcactggcactggcatcttgaacttaacagaactcctcatcgtctcctccatctgattccccactcccagtgtgcagtcaccccacttccctgctcccctcttccctttgccccagccccacctcctacctcccacagtcctctgcccttccatagagaaacgcttgcctcctgtaaagcccagctcatatgcatttgccttccagaagattccccagctagtggcaactcacccccttgaggggaagaccactacccacctctgtcaccttctgtcacacataggagttactgttcatgatgatctgaatgtacgtgccccccataaatttctgtgttgaaatcccaacccccaaggtgatggtattaggaggtggggcctttggcaggtcatttaggtcatgtgtgcagagtgagtggggccctcatgaatgggattagtgcccttataaaagaggtcctagaagctgggcatggtggctcacgcctgtagccccagctactcaggaggccaacgtgggaggatcacttgagcctttgggaacagcccaaattagctgggaatggtggctcatgcctgtaatcccagcactttgggaggctgaggctggagggttgcttgagcccaggagttcaaatccaacctgggcaacatggcatgcccatgtaaaaaaaatttttttttaattaaaacaaacaagaaaaagagtccctagagtgctctctagctctctttcttccatgtgaggatacaatgagttgttggcaatctgcagtcaggaagagggtcctcgccagagcccaccacgctagcaccctgacttccagcctccagagctgtgagaaatacatttatcatttaaaagccacccaatctatggtaatttctcttttattcttttcctttctttcttttcttttttttttttttttgggacaaagtcttgctctgtcacccaggctggagtacagtggcacaatcatagctcactgcaacgtggaactcctgggctcaagcgatcctcctgggctcaagcgatcctcctgcctcagcctctcgagtacctgggactacaagccgtgcattaccacaatggcaattttttttatttctgtagagatggggtctggctatgttgcctaggctggtctcgaactcctgacttcaagtgatcctcccaccttggcctcccaagtagctgggactacaaacgaattatttctcctttttcttctgtaggagtttgctagggctctacaccttttgtgttggaaggaccttcgtcataacattgtttttggcagattacttgaagggattgcaagccacagacctgctgccatataaggcctcatggagagtcccaaggtttatcaagagattctttagctgtgtgttagaaaagcccaactcaagctagcttaagaaaaatggggatttcctggctatggccaggagagacagataaatctcacccctagcacagctggatcccacaaggcctctgctgccctctgtgcacgggccccatatgttcctaacacaaggagcttctggaaacccacagacaatgtctgcaatcccgatacctggcactggctccccaggaacccccagtatgagcagcagggacagaccattgacaattgaagacctgcatggcgtcagtctccgtgcagaaggaagcagaggggagcaatggggttgctgatggacctaagaacagagaacccccaaactgtcggcagctcttccctgggaagtaccttgggtgaactggggaagagcagctgagactgggagggtttgggacactctggcctgcaggcaagtgcaaggggctggagcaatctaggtgctacgacctctgaaaacaaggcagccagtgcccttccctggcaacccttgcggtccaaattgggcagtgcagggacaagggggcaaaggagagaacaggtcccagcagcagtgggggaggggacaggagctgccaccagtgtaactagagctggtgtcatggcctacccctccctcctgaaagttctggaactgaatttcatgaagcaatgagcaagagaatcaaagtcagctcccaggcaaagtgattcgaggaaatacaggcaggtagggaaggggcggtcggtggtggcgcagagaagccagacttcttcaaatacaccttcttttctagattttaatttgagacttttaactgttttattacataattataaaacaaaatttaagtggccgggggcggtggctcacacctgtaatcccagcactttgggaagccgaggtgggcggacgacttgaggtcagcagttggagaccagcctggccaacatggtgaaaccctgtctctactaaaaataaaaaaaattagctgggcgtggtggcgggcacctgtagtcccagctcctcgggaggctgaggcaggagaatcgctcgaaccgaggaggcggaagttgcagtgagctgagatcgcgccactgcactccagcctgggcgacagagtaagactgtctcgaaaaaataaaataaagtaaaataaaagtttaaatttacagagcaatctctgaaaatcagcaacaaaagaaatgaagctaaatgcatatccactgagtggcatatcacttagagagggactattctaagggactggaaacacaccggtttactacacaacctagtggcatataccctcagggtaagaagacctgtgaagatgttaaggttttggtcaccaataggtgaaggcagggtaaggtgtccgaatgccgtcattttccatccccagtggtttaattggtctgggcattgagtttcagtagctgccaacaccccagaaaagagacactctccttgccaaaacacaccaacaaatccaacctgcctctggccagatcctcagatcaactaccaatttacagaaaaatcataatgaacaacgtcagaggggcctgttaggctacgtcatgaacgacttgcttgcttccacaaataaattgcagggagatagaaagggaacctctagattcaaaggtagtcaaaaggcatatcagtcaatctgaatgtgtggaccttatttgagccctgattcaagcagactgaaaatacgtatgacattttttgaacactactaggatatttgaagctattcaggaaatattgttacacttgtcggtgtgatgatgacttgtggttatgtattgagaagagcccttttctcctagaggaacatagtaaagatttacagagggaagggtgtgatgtcttggatttgcttccaagaatcaggaagaaagggtagtggaggggtcacagatgaaatgagatgaaaccgtggaagctgagtgatgggtaccggagttcattacactcctccctctactttagtagatgcttgaagttttgtggaaaaaaaaaaaaacccaccccgacatttgaaaagagtgcactgaagcatcatgcattgatgaagtctgggggcatctaggaagagactgttgacattgccaccaaggaaattctgggcacagtcatgttgaggtcaactgcaagatcctcatccggtttggtctgggcactctgtcactaattggcactcggtcctggccaccccacagcgggatgtttattggcaatcaaggagctggcgtggcttctggaaaccacagcctgcacgatgttgttgttttttgttttgttttgttttgagacaagagtctcactctgtggccaggctggagcatagtggcgtgatctcggctcactgcaacctccacctcccgggttcaagcgattctcctgcctcagcctcctgagtagctgggactacaggcatgcgccaccaagcccagctaatttttgcatttttagtagacatgaggtttcagtatgttggccaggatgatctctatctgttgacctcgtcatctgcccgcctctgcctcccaaagtgctgggattacaggcgtgagccactgtgcccggcctgcacgatgttcttgaaggcaccaaaggaatttggtttggaggagggacctggggagagggccaggagtggggcggtcactggtgtcctcagcttctttgagggcctgcgtgcaaaactttcggattgggcaactcccaatggcaggactcgggctgccctgatgagagctttcagctttctgttgggcctgagccctctctcccaggacggctccgaatggaaagatggccctgggcgccaatgcagcctcttcccccagaggtgtgcagccaaaagccaagtggccccatcatggagtttgacaaaatgactgctacaggctttgccgaccctgaagttctagaagtttcttgccctctgctgctgtcttccccaccctcccgcctcccttgggtgtgtcagtatgttgcctcctttcggcttcaaatgtaaagacagacccagctcttccccaggaagctgagggactccgtggaatgagaggtcattcgctagcagtgaacacactcatctacgggccacaaagaaagagcacataaactcttccccggcctcggattctcaaaggggctgggaagcctgtgtggcttgagaatgcatattcgatattatggtgtccttctagatttggagaggaccccccaattcatgtcatcagaaaagctatgggagaaagccttctctgctggtggggacgtgcagaagagagattcccttgggcggggcaggtgggtggccggtggcccccagtgcagccacccagcctccacgggcctgctggctcacctctggtggagttgctgttggtgtaggtgaagatgctggactgggtgctgtcctcatagctgtcctgcggatggcggcctgcgagcctttggaggctccactgctgggccatggctatggaaagccctgtccccgacggcagccggccctggtgcgtcacctgagggtcacggtgctttataccggccagtgggatcagcccgggcctcttcaccttaaaagctcccaaatcctacaccatctgatctcttaattgggcctgggacttagacctcctcctcccaccccttgcttccttgctcctgaggcgagcccccgggggcggctcagagggatttgctggaaacctgtaatcccagctactgggaggtcgaggcaggagaatcgcttgaatctgggaggcggaggttgcagtgagctgagatggcgccactgaactctagcctgggcaacagaccaagactctgtctaaaaaaaagtggctgggcacagtggcacacgcctgtaatcccagcactttgggaggccaaggcgggtagatctcctgaggtcaggagttcccgaccagcctgactaacatggtgaaaccccgtttctactaaataaaaaacaattagctgggcttagtggcaaatacctgtactcccagctacttgggaggctgagacaggagaatcgcttgtacctgggaggtcgaggttgcggtgagccaagatcgagccattgcactccagcctgggcaacaagagcaaaactctgtctcaagaaaaaaaatttaacaggccacctaattgcgattaaaaaaaaacaaaaccctgaatctgtttagattcccacttgcagggtatgtgacatcaccttctgccacattctcgccagccctggacattgttaggctttttaatttttggcgttctggtggatgagaaaatagtatttaattgttgcttttcgcttactattcccggatcaccttgcaattacatgttttattatacgttactgtcttttgtttttcgtcgtctgagatgtccgtggctaccctttaatgtctttatattgggttatttgctcttagtttactgatttgcagttctttatatattgtgttgattagccctttatctatcagatatgtttcaagcctttttttttcttgtttgcttttatttatttattttttgagatggggtctcagtctgccaccctggctggagggcagtggtgcgatcacggcagcctcgacatccccgggatcaagcgatcctcccgtctcagcgtcctgggtagctgggactacaggtgtgcaccaccactccaggataattgttgtattaatttttttttaatagagacggggtttcgccatgttgcccaggctggtcttgacctcctgggctcaagagatccacccaccttggcttccaaagtgctgggattacaggcatgagccagcacacccagcccttgtttttttttttttctccccctttctttctttcttttttgtttttgttttgattaatcaagtcccatttttttctcctcttggttatttggatgttatgtacatatgtagcttcttttctagtgattacttttttttttttttttgagacaatctcactcttgtcagtcaggctggagtgcagtggcgcagtctcggctcactgcaacctccgtctccccggctcaagcaattctcctgcctcagcctccccagtagctgggattacaggtgtgtgccaccatgcccggctaatttttgtatttttagtagggacagtgtttcgcagtgttgaccatgatggtctcaaactcctgacctcaagtgatccacccgccttggcttcccaaagtgctgggattacagctgtgagccaccacgcccggcccccccaccccccgctcttttttttttgagacaaggtctcactctgtcacccaggttggagggcagtagcacagtcacaggtcactgcagcctctacttgctgggcacaagtaatcctcctgcctcagcatcctgagtagctgggaccacaggtgcacaccactgccctggcaagacttgctttttaaacagttgttgaattcttacatttgtcagtggtgtactgaactccttcatgtctaaaaatgtctttagtctaaccccacagttgacagttggggtgtagaattttaggctgggaaatcatttttccctcagaatttcgaaagcagcacttcattgtctttttttttttttttttttttttttttgggacagagtcttgctctgtcgcccaggctggagtacaggggagtgatcctcggctcactgcaacctcttgggttcaagcgattctcttgcctcagcctcccgagtagctgggattacaggcgcccaccacaatgctggctaatttttgtatttttagtagagacagagtttcctcatgttggccagcctggtctcaaactcttgacttcaagtgatccgcctgcctgggcttcccagagtgctgagattacaggtgtgagccaccgtgcccggccagcacttcattgtcttctagttccccatgctgttgctgaagtctgaagccattctgacttctgattctttgaatgtgacctatttttttctctctgacagttattctctcagtgtatcgaagatatcagtcaactatcttctggattgcattgatgctattgagaaggcagcctgcagtctaaaagtcatggttttaaaggtaatcagctttttttcctctggctgcttttaacatcttgtgtcggccgcgggcggtggctcatgcttgtaatcccagcactttgggaggcccaggtgggcggatcatttgaggtcaggagttccagaccagcctggccaacatggtgaaacactgtctctactaaaaatacaaaaattagctgggcatggtggcgggcgcctgtattaccagctacttgggaggctgacgcaggagaatcgcttgaacccgggaggcagaggttgcagtgagccgagatcacgccactgtactccagcctgggcgacaagagcgaaacactgtttcaaaaaaaaaaaaaaaaaaaaaaaatctcgtgtctaggtgtggacctatttctgtcttccctgcttaggatttattgggcttcttgaatttgtgaatttgtgtctttcttcagttctggaaagttcttagggagttatctcttaaaatgttgctgctgtggccggtcgtagtggctcatgcctgtaatcccagcactttgggaggccgaggtgggtgggtcacctgatgttgagagttcgagaacagtcttgccaacatgatgaaaccccatctctactaaaaatacaaaagaattagctagctgtgatggcacgcgcctgtagtcccagctactcgggaggctgaggcacgagaagtgcttgaacccgggcagcagaggtcggccgtgagccgagattgtgccacggcactccgcctaggcaacagagtgtgactccatttcaatttaaaaaaaaaaaagaaaaatatgtatatattgctgctgcttcattctgtctgtcttctctctctggtgtgacaattggatttttgttagacctactcatgctaccttccatgtcttctatttttcaagttttctatttttttgtgcctctgtgctgcattctggatacttttttttctttctttcttttctctttctctctctctctctctctctctctctctctttctttcttgggatggagttttgctcttgttgcccaggttggagtgcagtggcgtgatctcggctcactgcaacctctgcctcctgggttcaagccattctcctgcctcagcctcccaagtagctgggattacaggtgcccaccaccatgcccagttaattttttgtattttttagtagagacagggtttcaccatgttggtcaggttagcctcaaactcctgacgtcaggtgatccacccgccttggcctcccaaaatgctgggattacaggcgtgtgagccaccgcgcccggcctggatactttctttagctcctctgtacaatttaccaacagtctctccagccatatcaaatctgccattaaatccatcaattgaacatattattatttattatttatttattttttgagacggagtctcactctaccacccaggctggagtgcagtggcacgatctcagctcactgcaacttctgcaccccgggttcaagcggttctcctgcctcagcctcccgagtagctgggactacaggcgtgtgccaccacgcctggctaattttgtatttctagtagagatggggtttctctgtgttggtcaggctggtcttgaactcccgacctcaggtgatccgcccgcctcggcctcccaaagtgctggaagtacaggtgtgaaccactgtgccaggcatttttttttttttttttgtattttgtatagacggggtttcaccatgttggccagactggtcttgacctcctgacctccgcccgcctcggcctcccaaagtgctgggattacaggcatgagccaccacacctggcctatattgaacatttaaatagtttgaaaactgtgaaatctggcatatgtatataaaggtgcagaaaacattgatgtatgttttaagaagtaacgataaggtgaacacacatttaaccactactcaggccaggcaccccagcctccacagtcaccccagtcataatccccttctcccgctctagtgggaaccaccatcctggggtttctgttgccaacatccatgctgctctttagctttcctgcctgtgtagtcatccctacacaatattgtttagttttgcctgctcttggaatttatgtaaatggaaccatatatagtatggattttctgtctggtttcttttgttcaacattatgcttgtgaaatgcattcatgtttttcaaggctgtagttcattctcattgctgtacagtagtatgttgttgcatatattacagtttacttacactttctgggcaggtggtttgttgctagttgttggatattgagaacatcagtgtacttgcctcctgggaatatcgcctatgaatgcagttgctggatcatttggtaggtatatcttcaactttgtgatactgtcaagtggttttctaaggtggctgtagtacaaatttgcttcccgccagtaatgattgagagttcctgttgcgctatatccttgccaactcttattgttgttagtctgtctgagtttgaccaatctactgggtacatagtggtatcactttgcattttaaaaattgaggtataggccagatgcagtggctcacaccggtaatcccagcactctttgggaggccgaggcgggaggatcacttgaggtcaggagttggaaaccagcctggtcaacatggtgaaaccctgtctctactaataatacacgaattagctgggtgtggtgatgcacacctgtaatcccagctactcgggaggctgagccatgagaattgcttaaacccgggaggcgaaggttgtagtgagccgagattgcaccactgcactccagcctgggtgacagagtgagactccgtctcaaaaaacaaaaaagtagaaacggaacagaggctgcacctgagctgccccccacctccctctcctagctccttgctctggtgggctgggttccagctatgctgctcttgccatctttattttagaggtaagaaaactgagcctcagagcagtttattaacttgctcaaggtctcagagtggtagagccaggatttgaactgggctcttcgtcaaaggcaatgttaatcccctcaccatgtgagagactcattcttttgtgttacagtagaattttctgccgtagactgtcagctgtatgagatcaaggaatgtatctggcttctgtaccacgtggtaggcactcagagaaagtatgtgttgaatgaatgattggatgaatgaatgaacctgttaggaggcaaatctctctgcctaacccttcctgtctccctgggagtagcaatacagcaagctgtaagagttgacggaaataagcttattccatactttacaagaacagttctttataaatgagacccacaattggtaatttttggaagagaaaataggagtgcagtgcaaaaacaggcagatgtagaagggagtctggccacctgtgggtcttagtgaggcacacatgtagagcaaggagtcagacgctgaaaaggaggggagaggggccctgaagatgagcatcacctcctcagtctgtgtcgggcccatcttgaatgcacaaatcttgcgtgtgtaagtatccatgcatatgtggaagtgttttatggagtcataacgtgtccaattctcccacactttgcggctcacagagcaccgtattgtgatttcttgtttcccaacgtaggcggaacacaccaggagccccagcgcaaccctcccctccaatgtgccttcatgccggtccctgtcatccagcgaagacggccccagtggcccttccagcctcgcagatggaggcctagcccacaacttacaggatagtgtcaggcaccgcatcctctacctctcagagcagctgagagtggagaaggccagtcgggatggcaacactgtgagctacctcaagctggtatccaaagcagaccggcaccaggtgccgcacatccagcaggcctttgagaaggtgaaccagcgcgcctctgccaccatcgcccagatcgagcacaggctccaccagtgtcaccagcagctccaggagctggaggaaggctgcaggcccgagggcttactgctgatggcagaaagcgacccagccaactgcgagccacccagtgagaaggccctgctttcagagccccccgagccaggtggggaagacgggccggtcaacctgcctcatgccagcaggcccttcatcttggagagtcgcttccagagcttacagcaggggacgtgcttagagacagaggatgtggcccagcaacaaaacctgctgttgcagaaggtaaaggcagagctggaagaagccaagaggttccacatcagcctccaggagtcctatcacagcctaaaggagaggtctctgactgacctgcagctgttgctggagtcccttcaggaggagaagtgtaggtgaggccttggctctggggactggaagcagaggaggaaccgctcccaggagccacctatgggagggtgaaagggagccaggacaggagcctggagagccagggtgaggggccagttggaagagcaggtccatgcttcttttagcgactgggccctgcagtggggcgagccagccctctccctgcagtcccacacctgccttgacccttgctagcgaaaatgctccagcttggcagcccctgccgggtggttgcagcggcatagcggctggccctgaccctgtggtggcaggggacaacatgggggtggcaagagtccggtagacacctggcactagttagggaggtggcgtcctttggtcccagtcggctgggaaggtgggagtcaggaccggagtcgcctcgccagctctggtctcttcacatgtgctcctagctgagctggggcacaggccgggtctcagatacttatttcaaaaatgactgccttctggtgaatgctttctccgcaccgtgcagtagctcgattttctttttcttttttttcttttgagatggagtctcactctgtcgccagactggagtgcagtggcacgatctcggcccactgcaacctccacctcccgggttcaagcgattctcctgcctcagcctcccgagtagctgggaatacaggcgtgcaccagcacatccggctattttttgtatttttagtacaggcggggtttcaccatgttgaccaggatggtctcaatctattgacctcgtgatccgcctgcctcagcctcccagagtgccgggattactggtgtgagccacctcaccctgccctagctcgattttctttccctctaagataaggctagggcctaccaattggaggaaaaaaaaaaaaaaaaaaaaaaaggcaaacccaatctctcaacggattctctccattcctattgggaccgttctctgggtttccatgggccctcagggggtgccacattctgtccccctcgctgcagtctgtggctaattaacgccagtccctccagcgtcctggctagggaggcagcgattcccttaggtgagccaagattctcagcatttgcatgaaaagaagaactccgcagtccttttagtgcctgatgcaggggaagcggcgtgtgggaatcatcctctttagtttccccagggaaatcttgccagcgtttacatggcctaagaatctgttaaaggacaatcaaagaatattacagggcaaccactgtcaatgagatgactagtcagagtcacaggcgtctcttgcagattattttcataggacatggcaaccaaatctaaaatcttgggagcatcaaagacccttttgtgaaaatcacacttacccggtcagctttctattaagcaacagcagaacttggtggcagttacaaacttccccgtatgtttccaagccacaggggccaatgagaatgctgtgctcaggtaaactcttaacccctgtcaaatccgagtctttcgccccctcttgatacagcggtgactaccggggagcagggcaatacctctgtctctccccctctcagacttttgctgcaaattctagaagcctgcacttctgacccggtaccccccattggactgtgacatgggatgtctggttgtttgctgcagcagcgagcctacccttactaatgttcatcgtgagcagaaaagcaggtctacagggcccaagcaggtctacaggaggagaaagggctgctgatgatttttcactgttgtcacgggctcgtaactgagctggggcaccaggttaagcagccttgttctttggccctcagacgcctactttatggttggggaagcagagtctcacagaggcacaagcaggctacgtggctgctaagtgcggacctgagagcatttcaccacaccctggctgtgtggctaagttagatgcaggggacacaggagttcatggcattttaaaaacatatacttccgtaaaatcttcttcaaaacttttacatgatctggacacagaagtgtttcaaccagccaggctccctgtgactgttgcgtcccctctggtgcatcacaaactgagaatccatactgcaagtcctgtgctgtttatcacagttaaatccgtttgctttcaggagggctgttgtggtttttatcattatggtttctttttaatttggtctcggcatgtctctactgagagtggccatagccgagatacccagtttctaggagatccctgacccgtgggaaagttaggttcggatgtgtgtgtcaggggagccacagtgaggaggcagacgaaaatgcatgaaacagcagaaatgggctgggcgtgggggctcacgcctgtaatcctagcactttgggaggttgaggtgggcagactgcttgagctcaggagtttgagaccagcctgggcaacatagtgagacccggtatctacaaaaacatcaaaaaattagctgggcgtgatggcgcgtgcctgtagtcacagctactcaggaggctgagcgggagcggggatcccttgagcccgggaggttgaggctgcagtgagtcatgattgcaccactgcactccattctgggtgacagagcaagaccctgtgtcaaaaaaaaaaaaaaaaaaaaagaaatgtatgactcagatcgaagagatgttaggtgtgctgatgggaggcagaggggaagtctggaggcagcagggagctgattgagctcatcagctgtgcaacagcgaagcccagaacggaagggcggggaagcttccggggctgtgcctgtattaaggtcacagggtgtgaagtgatcccacaggctttcctgcgggggttgtggattggctggtttaaagaaaacatgcacgaggaggaaactgatttacatgactctggtgttgagcattaggtcttatcgtggtcagcagccgtgggatgtgttgggttttgggtcagtgaggcgaggaccacgtgggctatgtcgcaaacaatcacatgacagggagggaggggtgttatctagggcaaaggtgacagggtacaactgctaaagttggatgctgaggcagcaactgtattaaacgcatttatgacaagggcttacttaaaaaaattgatgtagaattcacataatttcacgtaatgtgaaattaaccatttggaagcatgtaattcagtgcattaagtacatctgcagtgtggttcaaccatcacctctgtccggttgtctaacattctcatcaccccagaaggagacctccagactcactacacggtcactcctagcctcggctccaggcgttccctaatctgctttctgtctccgtgggtttgcctcttctggacttttcatataaatgggaccatacgatatgtgggcttttgtgtctagctcctttcactgttttcaaggttcactaatgttgtagcacgtatcagtacttcattctcttgacggctgactaatattccagtgcatgggtagaccacattttgtttatctgtccatcagtggatggagatttgagttgtttccaccttttggctattgtgagaagccctgcgctgaacactcagatacatgccagttgtttgaacaccagttttcaattctttggggtctataatcaggagtagaattgctggaccccgtggtgactccaggtgtagcgtttagaggagtcttcccacagcagccgcgcagctccatcttcccaccagcaatgcagaaggcttccagttgcctcacatccttgccaacatttgttgttatcctttttttttttttccaacagatgtaactgtgaagtggtatctcattatgagggctggctttcttttttatttttcctgagtctttggataggcaaaagttctttctttctttctttctttctttcttctttttctttttctctctttctttccatctctctctctctttctttctttttctttctctctttctctttcttcctttctctctgtctctctctctctctctctatctctctttctttctttctttttcttcagggtctctgttgcccaggctgcatgcagtcatagttcactacagccttgaactcccgggctcaagcgatcttcctgcctcagcctcccgagtagctgggagtacaaagcatgtgccaccatgcctggctaactttttaaaaattattattatttgtagagatgggatcttgctatgttgcccaggctggtcttgaacacctggccacggcctccccaagtactggggttacagatgtgagccactgtgcctggacagttcttactttttaatgcattttttaattgattgtggtaaaaaaaaaaaaaaacccacaatatattctttttgattctgcgacgtgcagggtctctatcacagcaacaattagactcaggaggcttggggctggccctggggtctcctccttcatgaggtctgggtttgtaggtccttgcagaggacgttcctgggtcctggaaggactgtgactgcttccgctggagttgcttgaggcccctggtaactctcctctctgtgtgctgaggagaagcacgggcgtcgcgaacttgatgattctggatggaagggtctttgccaagcttccctttctttcttgtggaaataggaggagcttcagatctccgagaagatgcacagtgagcggcctacctcctcagcacaagccagtctcctgggggaccagaaggccccggtccctcagtttcttcgtgggtcaggaggaaagaaggcttgagaaactcagaaaatgttcattggtagaagagatggcaccccaggaaggcatggggagccttcaagtaaaagtctcgactggccaggtctcatctgggcaccttgcatgcagagttgcaggaggccccctctagcctcctaatgagccagggggctctgggagggtcttgggggtccttccccatctcttacaggatgcgcagctgacttctgcttgatggtgaaaggcagtcaggtttcagtcttggccccgtagacagggcatggacaagtcctggagttgggggtatggtgccagcaaaaccatctttactctctggggtccatagccagtcccagcctgcccagccccaccctcctccttcacctttgtagcccgagtggtcaatgcctggggtagatgggttgctgggacatctttgttctttgttggatgagtaaaatggtcctgggagaaaacccgactgtgaggagcacattgcttcttttttttgtcttttttatgagatggagtctcactctgtcccccaggctggagtgcagtggcacgatctcggcccactgcaacctccacctcccgggttcaagcgattctcctgcctcagcctcccgagtagctgggattacaggcacacgccagcatgcctggctactttttgtatttttcagtagagatggggtttcgccatgttgaccaggggtctcgaactcctgacctgaagcgatccacccgcctcggcctcccaaagtgctggagttacaggtgtgagccaccacacctggctggaggacattgcttcttgccccatttctagttccctagacctgccttggcatcaactcattgaaggctccacttggtgacaaggaaccggcttatttggaaacagggtcgttgcggacgtgatgagttagatctggatgaggtcattctgcagaggggtgggccctaatgcagtgtgacctgtgtcctgacagaaaggggagacggagacacggacacacccagagggagagcgccgtgtggagacagaggctgaggccgacctgccgtggcagaagccaaggaagcccgcaggtgggcagcagagcagaagctgggacagaggccccgagtggaggcgccttctcggtcctcggcaggagcccgcccagcctgggccttcctctcggactgctggacccccagccaggagagaggccatctctgctgggaaagccactcaaagtttgtaacgctttgtgatggcagccagaggaaactcccacactcagcttgtcctttaggctctgctctgatgtcctctcctcaaagggacttcccaggctaccacgttcaaatggcctcttcttttattcttttggaagcggggttttttgaagtaaagtttttgtttttttgttttttttagatggagttttgctcttgttgcccagaccggagtgcaatggcgcaatctcggctcactgcaacctccgcctcctgagttcaagcgattctcctgcgtcagcctcccgagtagctgggattacaggcaggcaccaccacgcctggctaattttgtaattttagtagagatggggtttctccatgttggtcaggctggtctcgaactcctgtcctcaggcgatccacctgcctcggcctcccaaagtgctgggattacaggagtgagccaccgcgcctggcctttttgaggtaaattttatgcagtgaaattgcatttaagtttaggcatacagtttaacgagttttgacaaaggtttacacctgggcagctaaaatcccaataaagagctttgccaccaccccagaaagtaccctcataccctcttccagtgaatgcccgtctcccataattggccactgttccggtttctgtcactctagcttcatctccttttgaacttcacgtaagtggaatcgcacggcacgcagtgctttgtgtctggcggctttcgctccgtggaattgttttgagatccacccaagctgtgtgaagtgagtagctcatggcttcgtattgcttggcagccttccattgcatggagacgccgcaggttgcttatgccctggtccgctgccagttggggcgactgaataaagctgctatgaacgttctcgcacaagtctttctgtgaacatatgctttcatatatggaattgctagataacagggaagtgttatgtgtcttagtcccactttctgttgctgtaacagagtaccgcaggctgggtggtttataaagaaaggaagttcaatgtcaaggcgctggcagctggtgaggacctttgtacggcatcatcctatggcggaaggcagaagggcaagagggcgtgagagagcgagcgggggccaaactttcatgataacaatattaatattaatcgcctcttaccagtcccaccccttaacaccatcacatggccattaaatttcaacacgagttttgggggggacatgtaccccatagcagtatgcttaactttttaagaaagaggaaggccgggcgcggtggctcacccctgtaatcccagcactttgggaggctgaggcaggcggatcacctgaggtcgggagttcgagaccagcctgaacaacatggagtaaaccctgtctctactaaaaatacaaaattagcccggcgtggtggcacatgcctgtaatcccagctactcgggaggctgacgcaggagaatcgcttgaactcaggaggcggaggttgcggtgagccgagatcgtgccattgcactccagcctgggcaacgagtgaaactccatctcaaaaaaaaaaaaaagaggaactgttttccgacatggctataccattttacagtcccgctaggagtgtataagagttccagttgccaacgtttggcaagatcagtcttttaaatgtcagcctcttaagttcagccacaacttggtgaaattagactccaaaatttcatcaccctagcccatgttctctcgaccttggcactgtcgacattttggaccgaatgattctctgttgtgcggggctgtcctgtacattctaggatgatgagcagcatccctggtctccacttacttgatgccagtggtgccgtgaattaattgatgctgccgtgacaaattgcccccaacttcatggcttaaaataatagaaagttattctctcgcagtcctggaggctagaaggccgaaatccgtttcactgggctgaaatcaggcgaggaggacacacactcattggaggctctaggggacaaactgatctttgcctcttccagtttctggtggctgccaaattccttaattttgtggccacatcattcctgtcctgaaggccagcatcttcaaacctgtgttctgtcttcacatgacattctcgtctgtgtgtgtctaatgtccttctgcctctctctcatacatgtgattgcatttagggccaccaggataatctaggataatctttgcatctcaatacccttaaactcaccacttctggaaagcccccttttttggtcatagaaggtaacattcacagtttccaaggattatgacacagatatcttttgcggaggggctttttgtttttttcttttttagacagagtctctctctgtcacccaggctggagtgcagtggcacgatcttggctcactgcaacctccgcctcctgggttcaagcaattctcctgcctcagcctcccaagtagctgggactacaagcgcgtgccaccacacccagctaatttttttgtatttttcatagagacggggtttcaccctgttgctcagggtgttcttgaactcctgagcccaggtaatctgcccaccacagcctcacaaagtgctggggttacagatgtgagccaccgtgcccagcctaggggggcaattttagcctaccgtgccccacctatttgtaacaaccagaaatgtctgtccagagattgccaaatgtcccttgtttggggaggggggggccggcaaattgcccctggttgagaaccagtatcctagcccatgagactagtgggtgtgtgaccctgcctctgacgattaatgatgctgaaccccttttcatgtgcttatcagccaataagtctttggcttgttttcaacttggattgtctttttattgttgagttgtcagagctctttatatactccggaccagtctttgtcactcccctactttttcctttctcgcagcactcaccgcctaaactgctctcccttgtgtaggtattcatttgtgttgtattgttctcgtcaaaatatcagcacattcaggtcggccactgtgtctgagtgactgcccaaagacatgttggcacatgatggctgttctgtgagtacctgtttcatggatcagtctggatgctgcttttcctcccttcctgaagggacccagctcgccctctgggctgcctccctcctccatgtatgtcagaactctatctgctgtgtcttgggaacatcagggcagggccaggagggctgattctggatttaggcctggcccagcctcctctctgcaaggtatttactgaatgaccttggacgaggtgcttcaagtttgcaatcctcagtttccacatctgtaacatggaggtaaaaatgatcccactattgttggaactgttgtgagaattaattaatacttgtgtgtaagccccaagtagatgctgatggaactgaatttacaattcctttctgcttcctatgtgcaaactaagtccttgaaagatcgtaaagaaaaatggggccagatgtggtggcttatggctgtaatcccagtgctttgggaggtcgaggcaggaggattgcttcagcccaggagtctgagaccagcttgggtaacaaagtgagaccatatctctgcaaaaaattttaaaagtgttaaccggacttggtggcacatgcctgtagtccctgctacatgggaggctgagacaggaggatcgcttgagcccgagagttttatgttgcagtgaactatgattgtgccactgtgctccagcctgggtgatagaggacagagtgagaacttgtctcaaaaaaaaaaacagaaagagagagagagagagaggagagagagagagaggagagagagagagagagagagagagagagggagagagagagagagagagagagagagagagagagagaaagaaaaagagaaagaaagaaagaaagaaagaaagaaagaaagaaagttgttaatggcttttttttttttttgaggtggtgtcttgctctgctgcccaggctggagggagtgcagtggcttgatctcagctcactgcaacctctgcgtcccggattcaagtgattctcctgtctcagcctcctgagtagctgagattacaggcatgcaccaccacgcccagctaatttttgcatattttagtagagacggggtttcaccatgttggccaggatggtctcgatctcctgacctcgtgatccgcccgcctcggcctcccaaagtgctgggattacaggcatgactgcagccggccaatgtcttggaactattaatagccatggtggttgcacaacaccacatgtgctaaatgccgctgaattgttcaccttaaaataattcattttatgttacatgaaatttacctcaataaaaattgaataaaaaagaagctactcaggtgccgagtaggcaaaactttcactcttgctttgtatttctggctgtatccacaagtgggcagtcgtgaaattttcttatagcctcctgtcatattgaaaacgcccggaagtgaatatgccaggtctccatgtttttctttccctcctggacacgaggtccttgggggcatccagaccctagctcctctgtcccaagactgttctggtatgtttcgctttcagacgaggcttggagataacaggctatggttcctagaggcttcagtgttgctctgtgacctctcagccccagggatccagcctcgggctgactttcctcaaggtatctgcttagggctttgttgcaggctggggtcgtgttaacttccattttttccccgacttctcctccatgtcacagcatcctgcatcttgggatctctgaggaggtctgacctaaggtctgatctgctctctgaactggttcctctcatccctattgcgttgaagcaaagcacagacattatatcagttcatctgtaaatatttcagtgtgaacctgaaatatggatcattttgttaacatagcctaaataccataccaaaaatgttttaaaacaagtccacaatgttaaatatgcagtcactgtcaccttattgcctcacacatgccatcattcctttttatttctgaaggaattcttttttttttttttgtgagacagagcctcaccctgtcacccaggttggagtgcaatggtgagatctcggctcgctgcaacctctgcctcccaggttcaagcgattcccctgcctcagcctcctcagtagctgggattacaggcatgtgccaccacgcccggctagtttttgtatttttagtagagacggggtttcaccatgttggccaggctggtcttgaactcctgacctcgtgatctgcctgcctcggcctcccaaagtgctgggattacaggcgtgagccaccacacccggccctgaaggatattttttgctggacatagaattctaagttggcacttaatttttggaaataataagcattttgaacaaatcattcccttctgacttccatggtttctgttgaaaaggcagctgccagtcttcttgttgctcctcggatcacagttttgttttcctcaggctccttttaagatcttttgtttttctttgttgtttagtggttttgctatgatgatgtttggcgtgattttctttctctcttcttttttgtgccgctgactctccccttggtgtgattttctttgcattcatcctgcttgggcttcgcattgctacttgggtttatggcttgatgtcttttgtcagttttggacgttttcagccattatattttcaaatagtgactctgccctagtctctcatttttccccttctaaggccccagttacatgtatgttcaacctttccactgtatccctacatcctctgggttcctgtgtgagccgtcctggcgaatttcctcctgctttcgcttctgttttgttggctcttcccccagctccccagggccccttgctttggcacatttgctcagagtgagctcatccatcctggccacatgcaccgattgcacctgggctattgacccctcctacagctgtttctccgtctcagacttttcctccaagttgtgggccatgattaggctctagctcaatttgccaaaagcaaattctcagaaatgaccaagaatatactctttctggctgggcccaatggctcacacctgtaatcccagcactttgggaggccgaggcaggcgggtcacctgaggtcaggagttggagaccagcctggccaacatggtgaaaccctgtctctactaaaaatacaaaaaattagcccggcatgatggcgcatacctgtagtcccagctactcaggaggccgaggcaggaaaatcacttgaacccgggaggcggaggttgcagcaagccaagatcgtgccactgcactccagcctgggcaaatagaaggagatccgtctcaaaaaaaaaaaacaacaacactattttgaaaaaaacaataaagtttagaacactttgtgttggagagggtggtcttaacaccttcggtctgtcttgagggtgtctgggttgactggtcatcgttttgtgttcataagagcattctccagagttgtccatttgcttctgtgactgtaggaggtggagagaggggggtccttgaccaaggaagagaagggagcgcggctgccagagggccaggagatgggggccagagagaaggggagactgagagaatatccttatgaaaatattgtttactgacatctgaagagactcttcaagaatgcactgaagaatatcttcatgtatctttaccaatacattgatgaagattgacttcatattcctgaggacagttaaaatcttgaatgttctcacagctagatcattcatgtaaatggaaagacagtaatgaggaatctattttcggggtgaccatcctgccgacccactccccctctctgtgagcagtggcctagtccatgttgtccaccgactctcttcttaacagggacctggggcagagacaaatggaatattccttgaaatgctgcgaggaaccagcttttgacaaattggctttcaacaaatgagctgtcagcttattcagtgcccgggggatttctccgtgtgggtgttggtcaagtccttggagtgggaccgaatagaagtcgtcactgttttccccgtctctgtcagcaccaccgtttagacctcctgcacctgaggcctgccgccaccctcctgggcctcctggggcggcagccctgccagtctatgggttccatcacgctctggtgccttctctcttctacgtaagcggtggtgccagagccccctcactggccccctggcctctgtccttctggcccgttctttgtggtgccaaaaggggaacttcatagaagtttttaaattatgaagtatttcaagcaaagggaaaatgtaaggataacataattaacagccccagctttctgaaatcttaacatttgccatattcacttcaaatcttatttttttaggaaataaaactttaaaatattctgttgaagccctcattacccctttccagcaccatctcccttccttgctattctggccttgctatactggcctcaccattctcatttgggtgcttatcttttccatgcatggttttatacttttactacttatataattatatacacaacaggtagtgattgttttcttttagagatagggtctcactctgctgcccaggctggagtgcagtggcgtgatggcagctcactgcagcctcgaactcccggactcaagaggtcctcctgcctcagcctccagagtagctgagactacaggcgcgtgccaccacacccagataattaaaaattttttttgtagagacagggtctcactgtgttgcccaggctggtgttgaattcctcctggcctcaaacaatccccttgccttggcctcccaaagcgctgggattgcaactgtgaaccactgcgcctggcctgcttgtggttttttaacagctctattgagatataatttacatattataaaatgcaccattttaactacatttcaatggtttttagtaaatttactgagttgcgcaactattgccatgattcacttttctctttttgtttaaataacggctctattgagatataattcacatcccataaaattcaccaatttaaagtgtacaattcactggtttttcgtatagtcacagagttgttcaaccatcaccactatctaattccacaatattctcttttttttttttttgagacggagtctcgctctgtcgcccaggctggagtgcagtggtgtgaactctgctcaccgcaagctccgcctcccgggttcacgccattctcctgcctcagcctcccgagtagctgggactacaggcgtccgccaccacgcccggctaatttttttttgtatttttagtacagacggggtttcaccgtgtcagccaggatggtctcgatctcctgacctcatgatccgcccgccttggcctcccaaagtgctgggattacaggcgtgagccaccgtgcccggtcctacaatattttcaccagccccaaagcaaccctgtactcattagcagccactgcccatcccccacccccagcccctggcacccactaatctgctttctgtctctatggatttgcctattctggacatttcgtaactaatggaattgtactggaatctgtggtcttttgtggcttttcaatccttatagtcaccatgtttctatagagtaactgcaggctaaactgcaggctagacttcgtgctcaacactggtcctgggggatttgcggaactgaagagcacacacagatagttcacactgtcatttctacaacttctagtctgtggctatttttgtaaagctgttacaaaagagtaactacatataaaatatatatgaatattggtgtgcgtgtggctggtgtgtgtttggggtgttcccaggcagacctggagtgggaggcaggctttccctagagcctggggagcggggaggaaggcagaagctgaacccgaatctagtctaggtcaggaccgctcgctgttggcatgagctctggatgaggtactgaaggaatctcactttctcttttgctcccaaggcaagcattgatggaagaacaggtgaatggtcgcctgcagggacagctgaatgagatttacaacctcaaacacaatctggcctgcagcgaagagagaatggcctatctatcctatgagagagccaaggaaatatgggtgagaacctcctgggggagccttgcaagaagactggagggatgagcgaatctattctgatacccccaaaccaaagcaagacacgggtcctcgagctgccccctcctgagggttcgatggccacacacatttgtttcagagctagcagcatctgatctttacactcacgctccgcttcccaccatctggcttagctgcttttgccactctggtgctgcagtgctcacccgtgagcctctgactcgggagatctggggtggagctgcttctgctgcggctgcaggtgtagggagcgccctctcagaacccctccttagacctggcttccctctcctcacttttccattcccatagcgcccacccccgtccctgggtagctgtgtcttgaccaggtcctcagcttcgggagacagtggatgggggagtgcagccgggtcagatgaagctttccctgttgctggagagcctgcgccctcccctctgccctgaatgtgctctaggctctctgcttccctcctcgaatacccactccacagtgctttctgctcacccctaagaactcaataaacgaccacaactctgtgctgacttctggtgcgtgcattttcgtctcctgcaggagatcacggagaccttcaagagccgaatatccaagctggagatgctacagcaagtcacccaactggaggcagcggagcacctccaaagccgtcccccgcagatgttgttcaagttcctgagtccgcgcctctcactggcaaccgtcctcttggtctttgtctccaccttgtgtgcctgcccctcgtcactgatcagctcacgcctgtgcacctgcaccatgctgatgctgatcgggcttggggtcctggcctggcagaggtggcgcgccatccctgccacagactggcaggaatgggtcccctccaggtgtagactgtactccaaggactctgggcctccagcagatggaccttaaggggccaggagggccacctgccttagcttgctagctccctccctcctcctgggtgctgagggcatccagcaagcccctccacagctcttgcttgccgattatgtaaccaccagcctggtgaaatggatatagacgcccacctgcctcacacttctgttttgccaggatcctttcacgccatcggtagacatgaggctcgggaaaacttaaagtctatgaagcgctctctcctctttatcccccttgcaccctctcgagacccagtgcctgcacacgcagaggctcaggtggtcccacactgcagtgaaagcctctgtgactttgttggttttggcaaagataaattacatttattttacagggatggagaaggagggggaaaggagaggtggccaaagccccggtgggcgggatgggtaggaggcagacctcatgcaggcgataccgaggacacagatgagacctccgttttggaggcgctggagagttcagagccatcgtcaaccttcttcccgaaaagctgcaagatgcagtttcgaaactggaaggacagaaagcgttattgagcagagcagggaagggtggagcactgtgctgaatgtacgtgcccgagccttcccttcacccattccgaatcccatgggggatggaggaaggcttggattatttctccctcacacgcggggatgtcatctgacttagcagttgatggtgactacactgggttgaagtgggtcccccaaaagatgtgttcaggttaagatgaggtcacactggagcagggtgggccctaatcgaatgactggtgtcctgataagaaaaggaacgcttggacacggacacgcagacagagggaagaaggccacgtgaagatgaaggcagagactggggtgacacaccttggagtcaaggaacgccaaagactgccggcagccctgcagctgcttctccctcccggcctccatagggaacctttccatttgccaacaccctgatttcagactcaagatttccagaaccctgagagaatccatttctgtggtttgaagccactgagtttgtggtagtttgtgacggcagccccatgacactcatccacagtgacagctaaggggcagtggtgacctgtccccagactgtctggtgagcggctcggaggaatattaatgaaaaggcatgtggttgtcatgttttttccagtccatggatctggggcaaggtgaggcctaggtaatgacaatctagcccctacctcatctctccagccaagcgtcttccggtaccaggaggggtctgtctttgctgcttcaccccaaagagatctgggccatatgaatgtctcaaatcatgtcctgtgtcatcactgaagtaaccacaatgctttgaggacccagaccaaaggcattttctaaatatttcaggcctactcttgactagctctaactccctctatcatcaaaactctcaaaaataaaaaatataatggttgaaattaataacataagaaacgggacaaacagcagaatcagctcggctgaagagctgggagatagggctgaggaatccattcagcagctgctgcttgagcacccactgtgtgccagactctgtcctgagcaaaatttgctgtcttcatggaactgcgttccagaaaattctctcagaatgtggcaggacaggataattatgtggaaagggtaaaagcaaagttcgaggcctggtgaggtccagaagtgcagacatctgtctccccctgtccagggggagttctggaaaggagaatggaaataatccagtaaagacagtacttggcaagatagtttaggattccagaaacctaaaaaagatcctcatgaaagtcaggaaacaggggtcagggatagaactacactctgggcatcagtgtgctacagcgagttcccggaaatccactgcaggcctggtcctacttactgtttaaaagttaccagagagaatgaacccttaatgaactctgcagacttggcttgtgtgagtcaaagctgagccaaaggggctggagccattgagtggctctaagatggagaagcaaggaagagcccagtggaagggatggactgggcctggtgaaatgggaggcctctgcacacctttctggccaccatcaagtcacatcacagctgcgctttaatgaagcctgtaacctgcaggaggtggggggatttaggtgtgtgagcagcttgctgctgaggcccaatatgccagctaaggaggctgcctctgggcaggaccacagcacgtcccccctgaactaacccacgaactcgtgaaagctcttgaactcttggtcagtgtagccaaggagggccggcttttgttcttataggaagacaaattccagaggttacggtttgaaaatggagagatgaaggttgagaagggtcgagtctgaacagaagaggggcacacctagggtggatgtacctagggctcaccaactcctagagcgtctgaacgccaggagagcccctgaagctcggcagccatagttctagggccaccggaagggaagagcacacggcacacagacgctttgggaaatgccaccctcaggccgagactataaaggattccagagggcacacctaagccttctgctaagggccagccggagctctggctggggctgggtcacacgctgagcctttcccggtcatttccctggagggtcccccagatgctccgcgggcttcttatcagagacatgattccaggtggggccatcactgcacccttctagggcacacggtattttgagtgggatctgctgatggtgttgcttacctgccggttcataaagacatagataacggggttgtagatagtggcacttttggcaaagaaggccggcagggcagccatcaaagggtggaaggggtagccagggttggcagcagcaaagcatgcgaagaaggcgtatggtccccagcagaagcagaatgccaggaccatcaccaccaccatgcgcgtcacttccttctctgccttctgggtggattcagactctttctgctgctttgccacctaagggagacagggatagtgagtcgggggttggagggcagcaagaggcaggtgacccaggcatagggagttgtggggaggaggagaggagcccagcagccatcttccagccctgagtggagcacagccggccccaggcagacatggctgcctcaggctggccctgggggagttctagaattggaggtggcatgcagctaggtgtggcctaagatgaccccagagctggatctaacaagctcctttgcttcacctgatcccttaacagactgtcctgtcctgcgctcaggcctgagcatggaggcctgatttgattgatgactgggcgtggagaatgaaggagttaacaaggtggagatggcgggggaggcaaaagcagtggctggcggggtgcgcgatgggagtgtcagagcaatgcatacacttccctcaggcttcctaggccaggttggccactctgtggactaaatcctgccctggactcacggtgaggcagctgagggcagctttggtggggtggctccttcatgcctgctgggaggaaggagacgaatggcctccaggcagaggcactgtgggggaggccagaggccagccaccacctgccagggatgagggactggcggcaggcagatgagtggggatgagagagggagtgtgagggctggaatgcagggatggctgagacagcagagccggggccacattgtggagctggggctctaccatcccagactaatacagccgaagccatggttgggtacctgtgggagccttcaccccaaggtgacggggtgagggggcctttcacaggctcacagactcctctagagagagcttggcaggcatgcccatccaattgtgggcacaggcagcttcatataggaaagccagcaccctgaaagggctcccactgctaacagaaaagaaccagcctggctctcctcccttgctctgacttcctgaagggctcccagtggtagcctagtctaggggtggggggtgacggctgtggacaggatcagcttcccagggcagagggccagacatggaggtggagagtgggtcaggggggcaaatggcactctcgggtccactccttggtcggccccacagcctatgaaaaggacaagggtactccggtggcagcctcataaaaacacgccttgatttgcaggtgtcatttgctgatgtggctgctccactctactctgtgggaaaggcagcctttccaccccggggagaactgtccagggtcggggcaaggcacacctctgttcccttagtggactcctccagggagggagtggcagtgctttcccgtctcacagagctgaggacaacggggctggggctgaacctgcagccactggtacagtcccaaaggaatcacctgattctcatcgctggatcttaatattttcttataggggtaaaatcctcttctctaaggatttttggaaaaatagtttaggagtctcagtggactcatttgagggcagagcagcttaggggcaggaggcgggtgaggccaggaggaatcggggggcttaccgctcggatggccagccacacttggaggtagcagagcacgatgatgctgagtggggtgatgcagcaggtgaccatgaggacaatcatgtaagactgcaccccggggtacgagctgccgctgaacacgtctgggccgcatgaagtcttcaggccgtggggccagtacctggagagaagggccggcagccagtcctgatgcagggtggggtgacccaggacccccggcccaggcacggtgctaactcgggtggggtttgtttttttaaattgaggtgaaattcatgttgcatgagattacccaatttgaagtgatcaattctgtggcagtcaccacctctgcttccagaacattttcatcaacccaaaacaaaaccgttgggtaggattttggttaatccttgtccatttttagatgtcatgcctttcttctttttgaattgtggtaaaatacacatcacataaaatgtaccattataggccaggcacaatggctcacgcctatagtcccagcacatttggaggcagaggtaggaggattgctcgagcccaggagttcaagactagcctggatcacatagtgagatcttgtctctacaaaaaataaaaaaaattagctgggtgaagtggtgcacctgtaggcccagctcctcaggaggctgaggtaggaggatcacttgagcccaggaggtggaggctgcagtgagccataattacaccactgcactgtgccagcctgagtgacagagtgagaccctgtctcaaaaaaagaaaaaagtaccattgtgacctttggtacattcacaatgctgtgcaaccatctccactatctgcttccaggacattttcatcttcccaatcactccccttctttacaaagggattgtgaggttccttcttgccctgaccttctgagaacacccatgaagagctgagtcttttatctgaggtcagctaggccatgactgaaataaagggccctgctcacttagtggcctggaggattaaatgagataacccgcgggagagcctccaccagggtcagctcaccacacatgtttgataacgggcagctgtgtggggcatggcggcatgaggagggcgggagacagagacaggcttccacaaggtttgtttcctagaattgtggaacgttctcgaggaaagaacattccctctccaaacaccacgagaacttattcacgagcttgtcgataaaacagtgaaatgctgtcccacccagtccactccaatcaaacatttgagccacttgcttggcctggccaggacatgtgctctgtaggcccaggtggatctatgacccaagcagcctctgaaaggtggggggcgtggtgcggcagcgtgtgcaagaaagagacctggaatgcaaacacgctatgcgttcactgacagctgtgctgatggcctgagctccgtgtgcgcctgtgacctgatcgtgcttgggataaatatgtttccagaggttcggggaccacagagcctttcctatgttgcagccacattcatacattgatagacattgcacgctcagaggggcccagagaaaggaagtgatttgccttaaggtcacagagtctgaccctgcccactccatcttgcgtcctcgcacccttacctgctccaaccaaagatgggcggggctgtccacacagcagcccagatccaggagaaggcaatgcccacgatggccagcttggcatcaaatctcacattgccaaagggcttgcagaccaccatccatctctcccaggaaatgatggccagagaccagagacctgtgatccctatggggagagcagacagatgagggctttgagccaaagcaaaggtgggaagcaaagcttcccactgtcctgcttagaccccaaacgtctgcacacagaattcagggctccacggactgaggtggaaaaaacgacatctttctttccaccaacctcgaacagacactggacatttccttccattatgaacgtggcagtattagcagtacccgtgactcggtcagcaagagaggtcacagatgttttcctgtcaattcatagaggtggcagagagttcgaataccacttatgttcatcactactctgaaataacagtggttgtcaggcgggatcctgttatttaataccttaatactgagtggtgtcactaatacgtttaacacatgcttttatttttatttactttttgagacagaatctcactctgttgcccaggctgagtgcagtggtgccatcatagctcactgcagccttgacctccagagctcaagcgatcctcccgcctgagcctcctgagtagctgggactactggtgtgccaccacgcccagctgtttttatttgttgtagagaagaggtctcactatgttgcccaggctggtctcaaactcttggaggcaagcagtcctcccacctcagcctcccaaagtgctgggattacaggtatgagcctggccagtaaatgcttttaactaaagactatgttactgatgaatgtttaatactttgataactgtatttcagtataatttgctgcctttgtaatcctatgggtctcattttatgcgtttgcaaaaattctcctgagatggggtccacaggcttcccagatggccaagggcatccgtggaccaaaagtggtggggaagtgctggctgcttggcacctgactgacccaagaacagaccatgagcagaggcaagggtgagcgggagaccatggcagaaacggagacagacgtgggcggagatgcaggggggcactcgggaagggtcgtgtgaccaccgaggccatgcctgctgcagagagcactcggacccggggatggaccttctctgcctgaccttcccttggctccccttctacactatcggggtagtgccgggacttggacaagcaccctctctggtctgggccatcgtgggtacaatttgaggcagttaacggggtggggttggggaggctgctaagagtggtggggaggcaagagcaggagctgctgctgctggatgtggggtctcctcctcctgaaagaaagtcccagctcctgggcatgacgtctgaggcctctgagacctgggcctgcccacctcgtgtccagcagccacggctgcttggtggtactctatccactcgaaccacaaactgctcccagccgctcctccaccacctgccccaggccccttcttgtctgagaggactgatgatggtactgtgtggttgccgtctggctatagggccccctccttagcacagagcctggcacgctagtacctctccgccactgtctcctgacctgagcggaatagtggcccacagagatattagtgatggggatggggagaggatctgggaattgtgtctcctccgggaaaagcagatgctggcgagctgaaagagcaggcatccctaattgcaggggagttctgtccagggtgcccagagtccccgcccccctactgttctggggttgtctagctctgtatctgtctcctcccacaccagccccacagctccaaactggctgtccccgggcagagcctgactcaagagtaggaactcagggtatgtttgactcaagggagctgaatttaatgtgagtgttcagatggaagcctccagaacccttcagtatatggatgtgaggcgcagatgtggagggagacaggcctacaggagcagctgggccccgatcatcatgaggtggccggaggggcttgcagggtgaatgagtggtttccgccgagcctgggccccgactggcttaccacacagggagacggtgtagccctccaggacacacatagggtggcccagcacgaagtagccatagacctggttcacaacgctgatagtgctggcgatgacggtctctgccaggtcagcgaccgccaggttcaccaggatccagttcagcgggtggcgcagcttcttgaacttcatggtggccgccagcacaagcccatttgtgaagacggatgcaatgaccacaaagatcatccagacactggtgaggtggtacacccatctgggagcgatgtggtaattcgggccttcgaaggggcctgagggcaggaggcagaggagagagaggagctgggctgcagcaccgcctgtctataccagtgctgatcccacctctcccctcccccttccgccctcctgcctttgcaattggctgtttccctccagctttgtccatcctcagacagtctcccctccatcctgtccctcaagccagagaccatcgcccgctggtcactggcactggcatcttgaacttaacagaactcctcatcgtctcctccatctgattccccactcccagtgtgcagtcaccccacttccctgctcccctcttccctttgccccagccccacctcctacctcccacagtcctctgcccttccatagagaaacgcttgcctcctgtaaagcccagctcatatgcatttgccttccagaagattccccagctagtggcaactcacccccttgaggggaagaccactacccacctctgtcaccttctgtcacacataggagttactgttcatgatgatctgaatgtacgtgccccccataaatttctgtgttgaaatcccaacccccaaggtgatggtattaggaggtggggcctttggcaggtcatttaggtcatgtgtgcagagtgagtggggccctcatgaatgggattagtgcccttataaaagaggtcctagaagctgggcatggtggctcacgcctgtagccccagctactcaggaggccaacgtgggaggatcacttgagcctttgggaacagcccaaattagctgggaatggtggctcatgcctgtaatcccagcactttgggaggctgaggctggagggttgcttgagcccaggagttcaaatccaacctgggcaacatggcatgcccatgtaaaaaaaatttttttttaattaaaacaaacaagaaaaagagtccctagagtgctctctagctctctttcttccatgtgaggatacaatgagttgttggcaatctgcagtcaggaagagggtcctcgccagagcccaccacgctagcaccctgacttccagcctccagagctgtgagaaataaatttatcatttaaaagccacccaatctatggtaatttctcttttattcttttcctttctttcttttcttttttttttttttttgggacaaagtcttgctctgtcacccaggctggagtacagtggcacaatcatagctcactgcaacgtggaactcctgggctcaagcgatcctcctgggctcaagcgatcctcctgcctcagcctctcgagtacctgggactacaagccgtgcattaccacaatggcaattttttttatttctgtagagatggggtctggctatgttgcctaggctggtctcgaactcctgacttcaagtgatcctcccaccttggcctcccaagtagctgggactacaaacgaattatttctcctttttcttctgtaggagtttgctagggctctacaccttttgtgttggaaggaccttcgtcataacattgtttttggcagattacttgaagggattgcaagccacagacctgctgccatataaggcctcatggagagtcccaaggtttatcaagagattctttagctgtgtgttagaaaagcccaactcaagctagcttaagaaaaatggggatttcctggctatggccaggagagacagataaatctcacccctagcacagctggatcccacaaggcctctgctgccctctgtgcacgggccccatatgttcctaacacaaggagcttctggaaacccacagacaatgtctgcaatcccgatacctggcactggctccccaggaacccccagtatgagcagcagggacagaccattgacaattgaagacctgcatggcgtcagtctccgtgcagaaggaagcagaggggagcaatggggttgctgatggacctaagaacagagaacccccaaactgtcggcagctcttccctgggaagtaccttgggtgaactggggaagagcagctgagactgggagggtttgggacactctggcctgcaggcaagtgcaaggggctggagcaatctaggtgctacgacctctgaaaacaaggcagccagtgcccttccctggcaacccttgcggtccaaattgggcagtgcagggacaagggggcaaaggagagaacaggtcccagcagcagtgggggaggggacaggagctgccaccagtgtaactagagctggtgtcatggcctacccctccctcctgaaagttctggaactgaatttcatgaagcaatgagcaagagaatcaaagtcagctcccaggcaaagtgattcgaggaaatacaggcaggtagggaaggggcggtcggtggtggcgcagagaagccagacttcttcaaatacaccttcttttctagattttaatttgagacttttaactgttttattacataattataaaacaaaatttaagtggccgggggcggtggctcacacctgtaatcccagcactttgggaagccgaggtgggcggacgacttgaggtcagcagttggagaccagcctggccaacatggtgaaaccctgtctctactaaaaataaaaaaaattagctgggcgtggtggcgggcacctgtagtcccagctcctcgggaggctgaggcaggagaatcgctcgaaccgaggaggcggaagttgcagtgagctgagatcgcgccactgcactccagcctgggcgacagagtaagactgtctcgaaaaaataaaataaagtaaaataaaagtttaaatttacagagcaatctctgaaaatcagcaacaaaagaaatgaagctaaatgcatatccactgagtggcatatcacttagagagggactattctaagggactggaaacacaccggtttactacacaacctagtggcatataccctcagggtaagaagacctgtgaagatgttaaggttttggtcaccaataggtgaaggcagggtaaggtgtccgaatgccgtcattttccatccccagtggtttaattggtctgggcattgagtttcagtagctgccaacaccccagaaaagagacactctccttgccaaaacacaccaacaaatccaacctgcctctggccagatcctcagatcaactaccaatttacagaaaaatcataatgaacaacgtcagaggggcctgttaggctacgtcatgaacgacttgcttgcttccacaaataaattgcagggagatagaaagggaacctctagattcaaaggtagtcaaaaggcatatcagtcaatctgaatgtgtggaccttatttgagccctgattcaagcagactgaaaatacgtatgacattttttgaacactactaggatatttgaagctattcaggaaatactgttacacttgtcggtgtgatgatgacttgtggttatgtattgagaagagcccttttctcctagaggaacatagtaaagatttacagagggaagggtgtgatgtcttggatttgcttccaagaatcaggaagaaagggtagtggaggggtcacagatgaaatgagatgaaaccgtggaagctgagtgatgggtaccggagttcattacactcctccctctactttagtagatgcttgaagttttgtggaaaaaaaaaaaaacccaccccgacatttgaaaagagtgcactgaagcatcatgcattgatgaagtctgggggcatctaggaagagactgttgacattgccaccaaggaaattctgggcacagtcatgttgaggtcaactgcaagatcctcatccggtttggtctgggcactctgtcactaattggcactcggtcctggccaccccacagcgggatgtttattggcaatcaaggagctggcgtggcttctggaaaccacagcctgcacgatgttgttgttttttgttttgttttgttttgagacaagagtctcactctgtggccaggctggagcatagtggcgtgatctcggctcactgcaacctccacctcccgggttcaagcgattctcctgcctcagcctcctgagtagctgggactacaggcatgcgccaccaagcccagctaatttttgcatttttagtagacatgaggtttcagtatgttggccaggatgatctctatctgttgacctcgtcatctgcccgcctctgcctcccaaagtgctgggattacaggcgtgagccactgtgcccggcctgcacgatgttcttgaaggcaccaaaggaatttggtttggaggagggacctggggagagggccaggagtggggcggtcactggtgtcttcagcttctttgagggcctgcgtgcaaaactttcggattgggcaactcccaatggcaggactcgggctgccctgatgagagctttcagctttctgttgggcctgagccctctctcccaggacggctccgaatggaaagatggccctgggcgccaatgcagcctcttcccccagaggtgtgcagccaaaagccaagtggccccatcatggagtttgacaaaatgactgctacaggctttgccgaccctgaagttctagaagtttcttgccctctgctgctgtcttccccaccctcccgcctcccttgggtgtgtcagtatgttgcctcctttcggcttcaaatgtaaagacagacccagctcttccccaggaagctgagggactccgtggaatgagaggtcattcgctagcagtgaacacactcatctacgggccacaaagaaagagcacataaactcttccccggcctcggattctcaaaggggctgggaagcctgtgtggcttgagaatgcatattcgatattatggtgtccttctagatttggagaggaccccccaattcatgtcatcagaaaagctatgggagaaagccttctctgctggtggggacgtgcagaagagagattcccttgggcggggcaggtgggtggccggtggcccccagtgcagccacccagcctccacgggcctgctggctcacctctggtggagttgctgttggtgtaggtgaagatgctggactgggtgctgtcctcatagctgtcctgcggatggcggcctgcgagcctttggaggctccactgctgggccatggctatggaaagccctgtccccgacggcagccggccctggtgcgtcacctgagggtcacggtgctttataccggccagtgggatcagcccgggcctcttcaccttaaaagctcccaaatcctacaccatctgatctcttaattgggcctgggacttagacctcctcctcccaccccttgcttccttgctcctgaggcgagcccccgggggcggctcagagggatttgctggaaacctgtaatcccagctactgggaggtcgaggcaggagaatcgcttgaatctgggaggcggaggttgcagtgagctgagatggcgccactgaactctagcctgggcaacagaccaagactctgtctaaaaaaaagtggctgggcacagtggcacacgcctgtaatcccagcactttgggaggccaaggcgggtagatctcctgaggtcaggagttcccgaccagcctgactaacatggtgaaaccccgtttctactaaataaaaaacaattagctgggcttagtggcaaatacctgtactcccagctacttgggaggctgagacaggagaatcgcttgtacctgggaggtcgaggttgcggtgagccaagatcgagccattgcactccagcctgggcaacaagagcaaaactctgtctcaagaaaaaaaatttaacaggccacctaattgcgattaaaaaaaaaccaaaaccctgaatctgtttagattcccacttgcagggtatgtgacatcaccttctgccacattctcgccagccctggacattgttaggctttttaatttttggcgttctggtggatgagaaaatagtatttaattgttgcttttcgcttactattcccggatcaccttgcaattacatgttttattatacgtttactgtcttttgtttttcgtcgtctgagatgtccgtggctaccctttaatgtctttatattgggttatttgctcttagtttactgatttgcagttctttatatattgtgttgattagccctttatctatcagatatgtttcaagcctttttttttcttgtttgcttttatttatttattttttgagatggggtctcagtctgccaccctggctggagggcagtggtgcgatcacggcagcctcgacatccccgggatcaagcgatcctcccgtctcagcgtcctgggtagctgggactacaggtgtgtaccaccactccaggataattgttgtattaattttttttttaatagagacggggtttcgccatgttgcccaggctggtcttgacctcctgagctcaagagatccacccaccttggcttccaaagtgctgggattacaggcatgagccagcacacccagcccttgttttattttctccccctttctttctttcttttttgtttttgttttgattaatcaagtcccatttttttctcctcttggttatttggatgttatgtacatatgtagcttcttttctagtgattactttttttttttttttgagacaatctcactcttgtcagtcaggctggagtgcagtggcgcagtctcggctcactgcaacctccgtctccccggctcaagcaattctcctgcctcagcctccccagtagctgggattacaggtgtgtgccaccatgcccggctaatttttgtatttttagtagggacagtgtttcgcagtgttgaccatgatggtctcaaactcctgacctcaagtgatccacccgccttggcttcccaaagtgctgggattacagctgtgagccaccacgcccggcccggcccccccccccccgctcttttttttttgagacaaggtctcactctgtcacccaggttggagggcagtagcacagtcacaggtcactgcagcctctacttgctgggcacaagtaatcctcctgcctcagcatcctgagtagctgggaccacaggtgcacaccactgccctggcaagacttgctttttaaacagttgttgaattcttacatttgtcagtggtgtactgaactccttcatgtctaaaaatgtctttagtctaaccccacagttgacagttggggtgtagaattttaggctgggaaatcatttttccctcagaatttcgaaagcagcacttcattgtcttttttttttttttttttttttttttttgggacagagtcttgctctgtcgcccaggctggagtacaggggagtgatcctcggctcactgcaacctcttgggttcaagcgattctcttgcctcagcctcccgagtagctgggattacaggcgcccaccacaatgctggctaatttttgtatttttagtagagacagagtttcctcatgttggccagcctggtctcaaactcttgacttcaagtgatccgcctgcctgggcttcccagagtgctgagattacaggtgtgagccaccgtgcccggccagcacttcattgtcttctagttccccatgctgttgctgaagtctgaagccattctgacttctgattctttgaatgtgacctatttttttctctctgacagttattctctcagtgtatcgaagatatcagtcaactatcttctggattgcattgatgctattgagaaggcagcctgccgtctaaaagtcatggttttaaaggtaatcagctttttttcctctggctgcttttaacatcttgtgtcggccgcgggcggtggctcatgcttgtaatcccagcactttgggaggcccaggtgggcggatcatttgaggtcaggagttccagaccagcctggccaacatggtgaaacactgtctctactaaaaatacaaaaattagctgggcatggtggcgggcgcctgtagtaccagctacttgggaggctgacgcaggagaatcgcttgaacccgggaggcagaggttgcagtgagccgagatcacgccactgtactccagcctgggcgacaagagcgaaacactgtttcaaaaaaaaaaaaaaaaaaaaaatctcgtgtctaggtgtggacctatttctgtcttccctgcttaggatttattgggcttcttgaatttgtgaatttgtgtctttcttcagttctggaaagttcttagggagttatctcttaaaatgttgctgctgtggccggtcgtagtggctcatgcctgtaatcccagcactttgggaggccgaggtgggtgggtcacctgatgttgagagttcgagaacagtcttgccaacatgatgaaaccccatctctactaaaaatacaaaagaattagctagctgtgatggcacgcgcctgtagtcccagctactcgggaggctgaggcacgagaagtgcttgaacccgggcagcagaggtcggccgtgagccgagattgtgccacggcactccgcctatgcaacagagtgtgactccatttcaatttaaaaaaaaaagaagaaaaatatgtatatattgctgctgcttcattctgtctgtcttctctctctggtgtgacaattggatttttgttagacctactcatgctaccttccatgtcttctatttttcaagttttctatttttttgtgcctctgtgctgcattctggatacttttttttctttctttcttttctctttctctctctctctctctctctctctctctctttctttcttgggatggagttttgctcttgttgcccaggttggagtgcagtggcgtgatctcggctcactgcaacctctgcctcctgggttcaagccattctcctgcctcagcctcccaagtagctgggattacaggtgcccaccaccatgcccagttaattttttgtattttttagtagagacagggtttcaccatgttggtcaggttagcctcaaactcctgacgtcaggtgatccacccgccttggcctcccaaaatgctgggattacaggcgtgtgagccaccgcgcccggcctggatactttctttagctcctctgtacaatttaccaacagtctctccagccatatcaaatctgccattaaatccatcaattgaacatattattatttattatttatttattttttgagacggagtctcactctaccacccaggctggagtgcagtggcacgatctcagctcactgcaacttctgcaccccgggttcaagcggttctcctgcctcagcctcccgagtagctgggactacaggcgtgtgccaccacgcctggctaattttgtatttctagtagagatggggtttctctgtgttggtcaggctggtcttgaactcccgacctcaggtgatccgcccgcctcggcctcccaaagtgctggaagtacaggtgtgaaccactgtgccaggcatttttttttttttttttgtattttgtatagacggggtttcaccatgttggccagactggtcttgacctcctgacctccgcccgcctcagcctcccaaagtgctgggattacaggcatgagccaccacacctggcctatattgaacatttaaatagtttgaaaactgtgaaatctggcatatgtatataaaggtgcagaaaacattgatgtatgttttaagaagtaacgataaggtgaacacacatttaaccactactcaggccaggcaccccagcctccacagtcaccccagtcataatccccttctcccgctctagtgggaaccaccatcctggggtttctgttgccaacatccatgctgctctttagctttcctgcctgtgtagtcatccctacacaatattgtttagttttgcctgctcttggaatttatgtaaatggaaccatatatagtatggattttctgtctggtttcttttgttcaacattatgcttgtgaaatgcattcatgtttttcaaggctgtagttcattctcattgctgtacagtagtatgttgttgcatatattacagtttacttacactttctgggcaggtggtttgttgctagttgttggatattgagaacatcagtgtacttgcctcctgggaatatcgcctatgaatgcagttgctggatcatttggtaggtatatcttcaactttgtgatactgtcaagtggttttctaaggtggctgtagtacaaatttgcttcccgccagtaatgattgagagttcctgttgcgctatatccttgccaactcttattgttgttagtctgtctgagtttgaccaatctactgggtacatagtggtatcactttgcattttaaaaattgaggtataggccagatgcagtggctcacaccggtaatcccagcactctttgggaggccgaggcgggaggatcacttgaggtcaggagttggaaaccagcctggtcaacatggtgaaaccctgtctctactaataatacacgaattagctgggtgtggtgatgcacacctgtaatcccagctactcgggaggctgagccatgagaattgcttaaacccgggaggcgaaggttgtagtgagccgagattgcaccactgcactccagcctgggtgacagagtgagactccgtctcaaaaaacaaaaaagtagaaacggaacagaggctgcacctgagctgccccccacctccctctcctagctccttgctctggtgggctgggttccagctatgctgctcttgccatctttattttagaggtaagaaaactgagcctcagagcagtttattaacttgctcaaggtctcagagtggtagagccaggatttgaactgggctcttcgtcaaaggcaatgttaatcccctcaccatgtgagagactcattcttttgtgttacagtagaattttctgccgtagactgtcagctgtatgagatcaaagaatgtatctggcttctgtaccacgtggtaggcactcagagaaagtatgtgttgaatgaatgattggatgaatgaatgaacctgttaggaggcaaatctctctgcctaacccttcctgtctccctgggagtagcaatacagcaagctgtaagagttgacggaaataagcttattccatactttacaagaacagttctttataaatgagacccacaattggtaatttttggaagagaaaataggagtgcagtgcaaaaacaggcagatgtagaagggagtctggccacctgtgggtcttagtgaggcacacatgtagagcaaggagtcagacgctgaaaaggaggggagaggggccctgaagatgagcatcacctcctcagtctgtgtcgggcccatcttgaatgcacaaatcttgcgtgtgtaagtatccatgcatatgtggaagtgttttatggagtcataacgtgtccaattctcccacactttgcggctcacagagcaccgtattgtgatttcttgtttcccaacgtaggcggaacacaccaggagccccagcgcaaccctcccctccaatgtgccttcatgccggtccctgtcatccagcgaagacggccccagtggcccttccagcctcgcagatggaggcctagcccacaacttacaggatagtgtcaggcaccgcatcctctacctctcagagcagctgagagtggagaaggccagtcgggatggcaacactgtgagctacctcaagctggtatccaaagcagaccggcaccaggtgccgcacatccagcaggcctttgagaaggtgaaccagcgcgcctctgccaccatcgcccagatcgagcacaggctccaccagtgtcaccagcagctccaggagctggaggaaggctgcaggcccgagggcttactgctgatggcagaaagcgacccagccaactgcgagccacccagtgagaaggccctgctttcagagccccccgagccaggtggggaagacgggccggtcaacctgcctcatgccagcaggcccttcatcttggagagtcgcttccagagcttacagcaggggacgtgcttagagacagaggatgtggcccagcaacaaaacctgctgttgcagaaggtaaaggcagagctggaagaagccaagaggttccacatcagcctccaggagtcctatcacagcctaaaggagaggtctctgactgacctgcagctgttgctggagtcccttcaggaggagaagtgtaggtgaggccttggctctggggactggaagcagaggaggaaccgctcccaggagccacctatgggagggtgaaagggagccaggacaggagcctggagagccagggtgaggggccagttggaagagcaggtccatgcttcttttagcgactgggccctgcagtggggcgagccagccctctccctgcagtcccacacctgccttgacccttgctagcgaaaatgctccagcttggcagcccctgccgggtggttgcagcggcatagcggctggccctgaccctgtggtggcaggggacaacatgggggtggcaagagtccggtagacacctggcactagttagggaggtggcgtcctttggtcccagtcggctgggaaggtgggagtcaggaccggagtcgcctcgccagctctggtctcttcacatgtgctcctagctgagctggggcacaggccgggtctcagatacttatttcaaaaatgactgccttctggtgaatgctttctccgcaccgtgcagtagctcgattttctttttcttttttttcttttgagatggagtctcactctgtcgccagactggagtgcagtggcacgatctcggcccactgcaacctccacctcccgggttcaagcgattctcctgcctcagcctcccgagtagctgggaatacaggcgtgcaccagcacatccggctattttttgtatttttagtacaggcggggtttcaccatgttgaccaggatggtctcaatctattgacctcgtgatccgcctgcctcagcctcccagagtgccgggattactggtgtgagccacctcaccctgccctagctcgattttctttccctctaagataaggctagggcctaccaattggaggaaaaaaaaaaaaaaaaaaaaaaaggcaaacccaatctctcaacggattctctccattcctattgggaccgttctctgggtttccatgggccctcagggggtgccacattctgtccccctcgctgcagtctgtggctaattaacgccagtccctccagcgtcctggctagggaggcagcgattcccttaggtgagccaagattctcagcatttgcatgaaaagaagaactccgcagtccttttagtgcctgatgcaggggaagcggcgtgtgggaatcatcctctttagtttccccagggaaatcttgccagcgtttacatggcctaagaatctgttaaaggacaatcaaagaatattacagggcaaccactgtcaatgagatgactagtcagagtcacaggcgtctcttgcagattattttcataggacatggcaaccaaatctaaaatcttgggagcatcaaagacccttttgtgaaaatcacacttacccggtcagctttctattaagcaacagcagaacttggtggcagttacaaacttccccgtatgtttccaagccacaggggccaatgagaatgctgtgctcaggtaaactcttaacccctgtcaaatccgagtctttcgccccctcttgatacagcggtgactaccggggagcagggcaatacctctgtctctccccctctcagacttttgctgcaaattctagaagcctgcacttctgacccggtaccccccattggactgtgacatgggatgtctggttgtttgctgcagcagcgagcctacccttactaatgttcatcgtgagcagaaaagcaggtctacagggcccaagcaggtctacaggaggagaaagggctgctgatgatttttcactgttgtcacgggctcgtaactgagctggggcaccaggttaagcagccttgttctttggccctcagacgcctactttatggttggggaagcagagtctcacagaggcacaagcaggctacgtggctgctaagtgcggacctgagagcatttcaccacaccctggctgtgtggctaagttagatgcaggggacacaggagttcatggcattttaaaaacatatacttccgtaaaatcttcttcaaaacttttacatgatctggacacagaagtgtttcaaccagccaggctccctgtgactgttgcgtcccctctggtgcatcacaaactgagaatccatactgcaagtcctgtgctgtttatcacagttaaatccgtttgctttcaggagggctgttgtggtttttatcattatggtttctttttaatttggtctcggcatgtctctactgagagtggccatagccgagatacccagtttctaggagatccctgacccgtgggaaagttaggttcggatgtgtgtgtcaggggagccacagtgaggaggcagacgaaaatgcatgaaacagcagaaatgggctgggcgtgggggctcacgcctgtaatcctagcactttgggaggttgaggtgggcagactgcttgagctcaggagtttgagaccagcctgggcaacatagtgagacccggtatctacaaaaacatcaaaaaattagctgggcgtgatggcgcgtgcctgtagtcacagctactcaggaggctgagcgggagcggggatcccttgagcccgggaggttgaggctgcagtgagtcatgattgcaccactgcactccattctgggtgacagagcaagaccctgtgtcaaaaaaaaaaaaaaaaaaaaaaaaaaagaaatgtatgactcagatcgaagagatgttaggtgtgctgatgggaggcagaggggaagtctggaggcagcagggagctgattgagctcatcagctgtgcaacagcgaagcccagaacggaagggcggggaagcttccggggctgtgcctgtattaaggtcacagggtgtgaagtgatcccacaggctttcctgcgggggttgtggattggctggtttaaagaaaacatgcacgaggaggaaactgatttacatgactctggtgttgagcattaggtcttatcgtggtcagcagccgtgggatgtgttgggttttgggtcagtgaggcgaggaccacgtgggctatgtcgcaaacaatcacatgacagggagggaggggtgttatctagggcaaaggtgacagggtacaactgctaaagttggatgctgaggcagcaactgtattaaacgcatttatgacaagggcttacttaaaaaaattgatgtagaattcacataatttcacgtaatgtgaaattaaccatttggaagcatgtaattcagtgcattaagtacatctgcagtgtggttcaaccatcacctctgtccggttgtctaacattctcatcaccccagaaggagacctccagactcactacacggtcactcctagcctcggctccaggcgttccctaatctgctttctgtctccgtgggtttgcctcttctggacttttcatataaatgggaccatacgatatgtgggcttttgtgtctagctcctttcactgttttcaaggttcactaatgttgtagcacgtatcagtacttcattctcttgacggctgactaatattccagtgcatgggtagaccacattttgtttatctgtccatcagcggatggagatttgagttgtttccaccttttggctattgtgagaagccctgcgctgaacactcagatacatgccagttgtttgaacaccagttttcaattctttggggtctataatcaggagtagaattgctggaccccgtggtgactccaggtgtagcgtttagaggagtcttcccacagcagccgcgcagctccatcttcccaccagcaatgcagaaggcttccagttgcctcacatccttgccaacatttgttgttatcctttttttttttttccaacagatgtaactgtgaagtggtatctcattatgagggctggctttcttttttatttttcctgagtctttggataggcaaaagttctttctttctttctttctttctttctttcttctttttctttttctctctttctttccatctctctctctctctttctttctttttctttctctctttctctttcttcctttctctctgtctctctctctctctctctatctctctttctttctttctttttcttcagggtctctgttgcccaggctgcatgcagtcatagttcactacagccttgaactcctgggctcaagcgatcttcctgcctcagcctcccgagtagctgggagtacaaagcatgtgccaccatgcctggctaactttttaaaaattattattatttgtagagatgggatcttgctatgttgcccaggctggtcttgaacacctggccacggcctccccaagtactggggttacagatgtgagccactgtgcctggacagttcttactttttaatgcattttttaattgattgtggtaaaaacaaaaaacccacaatatattctttttgattctgcgaagtgcagggtctctatcacagcaacaattagactcaggaggcttggggctggccctggggtctcctccttcatgaggtctgggtttgtaggtccttgcagaggacgttcctgggtcctggaaggactgtgactgcttccgctggagttgcttgaggcccctggtaactctcctctctgtgtgctgaggagaagcacgggcgtcgcgaacttgatgattctggatggaagggtctttgccaagcttccctttctttcttgtggaaataggaggagcttcagatctccgagaagatgcacagtgagcggccgacctcctcagcacaagccagtctcctgggggaccagaaggccccggtccctcagtttcttcgtgggtcaggaggaaagaaggcttgagaaactcagaaaacgttcattggtagaagagatggcacccaaggaaggcatggggagccttcaagtaaaagtctcgactggccaggtctcatctgggcaccttgcatgcagagttgcaggaggccccctctagcctcctaatgagccagggggctctgggagggtcttgggggtccttccccatctcttacaggatgcgcagctgacttctgcttgatggtgaaaggcagtcaggtttcagtcttggccccgtagacagggcatggacaagtcctggagttgggggtatggtgccagcaaaaccatctttactctctggggtccatagccagtcccagcctgcccagccccaccctcctccttcacctttgtagcccgagtggtcaatgcctggggtagatgggttgctgggacatctttgttctttgttggatgagtaaaatggtcctgggagaaaacccgactgtgaggagcacattgcttcttttttttgtcttttttatgagatggagtctcactctgtcccccaggctggagtgcagtggcacgatctcggcccactgcaacctccacctccccggttcaagcgattctcctgcctcagcctcccgagtagctgggattacaggcacacgccagcatgcctggctactttttgtatttttcagtagagatggggtttcgccatgttgaccaggggtctcgaactcctgacctgaagcgatccacccgcctcggcctcccaaagtgctggagttacaggtgtgagccaccacacctggctggaggacattgcttcttgccccatttctagttccctagacctgccttggcatcaactcattgaaggctccacttggtgacaaggaaccggcttatttggaaacagggtcgttgcggacgtgatgagttagatctggatgaggtcattctgcagaggggtgggccctaatgcagtgtgacctgtgtcctgacagaaaggggagacggagacacggacacacccagagggagagcgccgtgtggagacagaggctgaggccgacctgccgtggcagaagccaaggaagcccgcaggtgggcagcagagcagaagctgggacagaggccccgagtggaggcgccttctcggtcctcggcaggagcccgcccagcctgggccttcctctcggactgctggacccccagccaggagagaggccatctctgctgggaaagccactcaaagtttgtaacgctttgtgatggcagccagaggaaactcccacactcagcttgtcctttaggctctgctctgatgtcctctcctcaaagggacttcccaggctaccacgttcaaatggcctcttcttttattcttttggaagcggggttttttgaagtaaagtttttgtttttttgttttttttagatggagttttgctcttgttgcccagaccggagtgcaatggcgcaatctcggctcactgcaacctccgcctcctgagttcaagcgattctcctgcgtcagcctcccgagtagctgggattacaggcaggcaccaccacgcctggctaattttgtaattttagtagagatggggtttctccatgttggtcaggctggtctcgaactcctgtcctcaggcgatccacctgcctcggcctcccaaagtgctgggattacaggagtgagccaccgcgcctggcctttttgaggtaaattttatgcagtgaaattgcatttaagtttaggcatacagtttaacgagttttgacaaaggtttacacctgggcagctaaaatcccaataaagagctttgccaccaccccagaaagtaccctcataccctcttccagtgaatgcccgtctcccataattggccactgttccggtttctgtcactctagcttcatctccttttgaacttcacgtaagtggaatcgcacggcacgcagtgctttgtgtctggcggctttcgctccgtggaattgttttgagatccacccaagctgtgtgaagtgagtagctcatggcttcgtattgcttggcagccttccattgcatggagacgccgcaggttgcttatgccctggtccgctgccagttggggcgactgaataaagctgctatgaacgttctcgcacaagtctttctgtgaacatatgctttcatatatggaattgctagataacagggaagtgttatgtgtcttagtcccactttctgttgctgtaacagagtaccgcaggctgggtggtttataaagaaaggaagttcaatgtcaaggcgctggcagctggtgaggacctttgtacggcatcatcctatggcggaaggcagaagggcaagagggcgtgagagagcgagcgggggccaaactttcatgataacaatattaatattaatcgcctcttaccagtcccaccccttaacaccatcacatggccattaaatttcaacacgagttttgggggggacatgtaccccatagcagtatgcttaactttttaagaaagaggaaggccgggcgcggtggctcacccctgtaatcccagcactttgggaggctgaggcaggcggatcacctgaggtcgggagttcgagaccagcctgaacaacatggagtaaaccctgtctctactaaaaatacaaaattagcccggcgtggtggcacatgcctgtaatcccagctactcgggaggctgacgcaggagaatcgcttgaactcaggaggcggaggttgcggtgagccgagatcgtgccattgcactccagcctgggcaacgagtgaaactccatctcaaaaaaaaaaaaaagaggaactgttttccgacatggctataccattttacagtcccgctaggagtgtataagagttccagttgccaacgtttggcaagatcagtcttttaaatgtcagcctcttaagttcagccacaacttggtgaaattagactccaaaatttcatcaccctagcccatgttctctcgaccttggcactgtcgacattttggaccgaatgattctctgttgtgcggggctgtcctgtacattctaggatgatgagcagcatccctggtctccacttacttgatgccagtggtgccgtgaattaattgatgctgccgtgacaaattgcccccaacttcatggcttaaaataatagaaagttattctctcgcagtcctggaggctagaaggccgaaatccgtttcactgggctgaaatcaggcgaggaggacacacactcattggaggctctaggggacaaactgatctttgcctcttccagtttctggtggctgccaaattccttaattttgtggccacatcattcctgtcctgaaggccagcatcttcaaacctgtgttctgtcttcacatgacattctcgtctgtgtgtgtctaatgtccttctgcctctctctcatacatgtgattgcatttagggccaccaggataatctaggataatctttgcatctcaatacccttaaactcaccacttctggaaagcccccttttttggtcatagaaggtaacattcacagtttccaaggattatgacacagatatcttttgcggaggggctttttgtttttttcttttttagacagagtctctctctgtcacccaggctggagtgcagtggcacgatcttggctcactgcaacctccgcctcctgggttcaagcaattctcctgcctcagcctcccaagtagctgggactacaagcgcgtgccaccacacccagctaatttttttgtatttttcatagagacggggtttcaccctgttgctcagggtgttcttgaactcctgagcccaggtaatctgcccaccacagcctcacaaagtgctggggttacagatgtgagccaccgtgcccagcctaggggggcaattttagcctaccgtgccccacctatttgtaacaaccagaaatgtctgtccagagattgccaaatgtcccttgtttggggaggggggggccggcaaattgcccctggttgagaaccagtatcctagcccatgagactagtgggtgtgtgaccctgcctctgacgattaatgatgctgaaccccttttcatgtgcttatcagccaataagtctttggcttgttttcaacttggattgtctttttattgttgagttgtcagagctctttatatactccggaccagtctttgtcactcccctactttttcctttctcgcagcactcaccgcctaaactgctctcccttgtgtaggtattcatttgtgttgtattgttctcgtcaaaatatcagcacattcaggtcggccactgtgtctgagtgactgcccaaagacatgttggcacatgatggctgttctgtgagtacctgtttcatggatcagtctggatgctgcttttcctcccttcctgaagggacccagctcgccctctgggctgcctccctcctccatgtatgtcagaactctatctgctgtgtcttgggaacatcagggcagggccaggagggctgattctggatttaggcctggcccagcctcctctctgcaaggtatttactgaatgaccttggacgaggtgcttcaagtttgcaatcctcagtttccacatctgtaacatggaggtaaaaatgatcccactattgttggaactgttgtgagaattaattaatacttgtgtgtaagccccaagtagatgctgatggaactgaatttacaattcctttctgcttcctatgtgcaaactaagtccttgaaagatcgtaaagaaaaatggggccagatgtggtggcttatggctgtaatcccagtgctttgggaggtcgaggcaggaggattgcttcagcccaggagtctgagaccagcttgggtaacaaagtgagaccatatctctgcaaaaaattttaaaagtgttaaccggacttggtggcacatgcctgtagtccctgctacatgggaggctgagacaggaggatcgcttgagcccgagagttttatgttgcagtgaactatgattgtgccactgtgctccagcctgggtgatagaggacagagtgagaacttgtctcaaaaaaaaaaacagaaagagagagagagagagaggagagagagagagaggagagagagagagagagagagagagagagggagagagagagagagagagagagagagagagagagaaagaaaaagagaaagaaagaaagaaagaaagaaagaaagaaagaaagaaagttgttaatggcttttttttttttttgaggtggtgtcttgctctgctgcccaggctggagggagtgcagtggcttgatctcagctcactgcaacctctgcgtcccggattcaagtgattctcctgtctcagcctcctgagtagctgagattacaggcatgcaccaccacgcccagctaatttttgcatattttagtagagacggggtttcaccatgttggccaggatggtctcgatctcctgacctcgtgatccgcccgcctcggcctcccaaagtgctgggattacaggcatgactgcagccggccaatgtcttggaactattaatagccatggtggttgcacaacaccacatgtgctaaatgccgctgaattgttcaccttaaaataattcattttatgttacatgaaatttacctcaataaaaattgaataaaaaagaagctactcaggtgccgagtaggcaaaactttcactcttgctttgtatttctggctgtatccacaagtgggcagtcgtgaaattttcttatagcctcctgtcatattgaaaacgcccggaagtgaatatgccaggtctccatgtttttctttccctcctggacacgaggtccttgggggcatccagaccctagctcctctgtcccaagactgttctggtatgtttcgctttcagacgaggcttggagataacaggctatggttcctagaggcttcagtgttgctctgtgacctctcagccccagggatccagcctcgggctgactttcctcaaggtatctgcttagggctttgttgcaggctggggtcgtgttaacttccattttttccccgacttctcctccatgtcacagcatcctgcatcttgggatctctgaggaggtctgacctaaggtctgatctgctctctgaactggttcctctcatccctattgcgttgaagcaaagcacagacattatatcagttcatctgtaaatatttcagtgtgaacctgaaatatggatcattttgttaacatagcctaaataccataccaaaaatgttttaaaacaagtccacaatgttaaatatgcagtcactgtcaccttattgcctcacacatgccatcattcctttttatttctgaaggaattcttttttttttttttgtgagacagagcctcaccctgtcacccaggttggagtgcaatggtgagatctcggctcgctgcaacctctgcctcccaggttcaagcgattcccctgcctcagcctcctcagtagctgggattacaggcatgtgccaccacgcccggctagtttttgtatttttagtagagacggggtttcaccatgttggccaggctggtcttgaactcctgacctcgtgatctgcctgcctcggcctcccaaagtgctgggattacaggcgtgagccaccacacccggccctgaaggatattttttgctggacatagaattctaagttggcacttaatttttggaaataataagcattttgaacaaatcattcccttctgacttccatggtttctgttgaaaaggcagctgccagtcttcttgttgctcctcggatcacagttttgttttcctcaggctccttttaagatcttttgtttttctttgttgtttagtggttttgctatgatgatgtttggcgtgattttctttctctcttcttttttgtgccgctgactctccccttggtgtgattttctttgcattcatcctgcttgggcttcgcattgctacttgggtttatggcttgatgtcttttgtcagttttggacgttttcagccattatattttcaaatagtgactctgccctagtctctcatttttccccttctaaggccccagttacatgtatgttcaacctttccactgtatccctacatcctctgggttcctgtgtgagccgtcctggcgaatttcctcctgctttcgcttctgttttgttggctcttcccccagctccccagggccccttgctttggcacatttgctcagagtgagctcatccatcctggccacatgcaccgattgcacctgggctattgacccctcctacagctgtttctccgtctcagacttttcctccaagttgtgggccatgattaggctctagctcaatttgccaaaagcaaattctcagaaatgaccaagaatatactctttctggctgggcccaatggctcacacctgtaatcccagcactttgggaggccgaggcaggcgggtcacctgaggtcaggagttggagaccagcctggccaacatggtgaaaccctgtctctactaaaaatacaaaaaattagcccggcatgatggcgcatacctgtagtcccagctactcaggaggccgaggcaggaaaatcacttgaacccgggaggcggaggttgcagcaagccaagatcgtgccactgcactccagcctgggcaaatagaaggagatccgtctcaaaaaaaaaaaacaacaacactattttgaaaaaaacaataaagtttagaacactttgtgttggagagggtggtcttaacaccttcggtctgtcttgagggtgtctgggttgactggtcatcgttttgtgttcataagagcattctccagagttgtccatttgcttctgtgactgtaggaggtggagagaggggggtccttgaccaaggaagagaagggagcgcggctgccagagggccaggagatgggggccagagagaaggggagactgagagaatatccttatgaaaatattgtttactgacatctgaagagactcttcaagaatgcactgaagaatatcttcatgtatctttaccaatacattgatgaagattgacttcatattcctgaggacagttaaaatcttgaatgttctcacagctagatcattcatgtaaatggaaagacagtaatgaggaatctattttcggggtgaccatcctgccgacccactccccctctctgtgagcagtggcctagtccatgttgtccaccgactctcttcttaacagggacctggggcagagacaaatggaatattccttgaaatgctgcgaggaaccagcttttgacaaattggctttcaacaaatgagctgtcagcttattcagtgcccgggggatttctccgtgtgggtgttggtcaagtccttggagtgggaccgaatagaagtcgtcactgttttccccgtctctgtcagcaccaccgtttagacctcctgcacctgaggcctgccgccaccctcctgggcctcctggggcggcagccctgccagtctatgggttccatcacgctctggtgccttctctcttctacgtaagcggtggtgccagagccccctcactggccccctggcctctgtccttctggcccgttctttgtggtgccaaaaggggaacttcatagaagtttttaaattatgaagtatttcaagcaaagggaaaatgtaaggataacataattaacagccccagctttctgaaatcttaacatttgccatattcacttcaaatcttatttttttaggaaataaaactttaaaatattctgttgaagccctcattacccctttccagcaccatctcccttccttgctattctggccttgctatactggcctcaccattctcatttgggtgcttatcttttccatgcatggttttatacttttactacttatataattatatacacaacaggtagtgattgttttcttttagagatagggtctcactctgctgcccaggctggagtgcagtggcgtgatggcagctcactgcagcctcgaactcccggactcaagaggtcctcctgcctcagcctccagagtagctgagactacaggcgcgtgccaccacacccagataattaaaaattttttttgtagagacagggtctcactgtgttgcccaggctggtgttgaattcctcctggcctcaaacaatccccttgccttggcctcccaaagcgctgggattgcaactgtgaaccactgcgcctggcctgcttgtggttttttaacagctctattgagatataatttacatattataaaatgcaccattttaactacatttcaatggtttttagtaaatttactgagttgcgcaactattgccatgattcacttttctctttttgtttaaataacggctctattgagatataattcacatcccataaaattcaccaatttaaagtgtacaattcactggtttttcgtatagtcacagagttgttcaaccatcaccactatctaattccacaatattctcttttttttttttttgagacggagtctcgctctgtcgcccaggctggagtgcagtggtgtgaactctgctcaccgcaagctccgcctcccgggttcacgccattctcctgcctccgcctcccgagtagctgggactacaggcgtccgccaccacgcccggctaattttttttgtatttttagtacagacggggtttcaccgtgtcagccaggatggtctcgatctcctgacctcatgatccgcccgccttggcctcccaaagtgctgggattacaggcgtgagccaccgtgcccggtcctacaatattttcaccagccccaaagcaaccctgtactcattagcagccactgcccatcccccacccccagcccctggcacccactaatctgctttctgtctctatggatttgcctattctggacatttcgtaactaatggaattgtactggaatctgtggtcttttgtggcttttcaatccttatagtcaccatgtttctatagagtaactgcaggctaaactgcaggctagacttcgtgctcaacactggtcctgggggatttgcggaactgaagagcacacacagatagttcacactgtcatttctacaacttctagtctgtggctatttttgtaaagctgttacaaaagagtaactacatataaaatatatatgaatattggtgtgcgtgtggctggtgtgtgtttggggtgttcccaggcagacctggagtgggaggcaggctttccctagagcctggggagcggggaggaaggcagaagctgaacccgaatctagtctaggtcaggaccgctcgctgttggcatgagctctggatgaggtactgaaggaatctcactttctcttttgctcccaaggcaagcattgatggaagaacaggtgaatggtcgcctgcagggacagctgaatgagatttacaacctcaaacacaatctggcctgcagcgaagagagaatggcctatctatcctatgagagagccaaggaaatatgggtgagaacctcctgggggagccttgcaagaagactggagggatgagcgaatctattctgatacccccaaaccaaagcaagacacgggtcctcgagctgccccctcctgagggttcgatggccacacacatttgtttcagagctagcagcatctgatctttacactcacgctccgcttcccaccatctggcttagctgcttttgccactctggtgctgcagtgctcacccgtgagcctctgactcgggagatctggggtggagctgcttctgctgcggctgcaggtgtagggagcgccctctcagaacccctccttagacctggcttccctctcctcacttttccattcccatagcgcccacccccgtccctgggtagctgtgtcttgaccaggtcctcagcttcgggagacagtggatgggggagtgcagccgggtcagatgaagctttccctgttgctggagagcctgcgccctcccctctgccctgaatgtgctctaggctctctgcttccctcctcgaatacccactccacagtgctttctgctcacccctaagaactcaataaacgaccacaactctgtgctgacttctggtgcgtgcattttcgtctcctgcaggagatcacggagaccttcaagagccgaatatccaagctggagatgctacagcaagtcacccaactggaggcagcggagcacctccaaagccgtcccccgcagatgttgttcaagttcctgagtccgcgcctctcactggcaaccgtcctcttggtctttgtctccaccttgtgtgcctgcccctcgtcactgatcagctcacgcctgtgcacctgcaccatgctgatgctgatcgggcttggggtcctggcctggcagaggtggcgcgccatccctgccacagactggcaggaatgggtcccctccaggtgtagactgtactccaaggactctgggcctccagcagatggaccttaaggggccaggagggccacctgccttagcttgctagctccctccctcctcctgggtgctgagggcatccagcaagcccctccacagctcttgcttgccgattatgtaaccaccagcctggtgaaatggatatagacgcccacctgcctcacacttctgttttgccaggatcctttcacgccatcggtagacatgaggctcgggaaaacttaaagtctatgaagcgctctctcctctttatcccccttgcaccctctcgagacccagtgcctgcacacgcagaggctcaggtcgtcccacactgcagtgaaagcctctgtgactttgttggttttggcaaagataaattacatttattttacagggatggagaaggagggggaaaggagaggtggccaaagccccggtgggcgggatgggtaggaggcagacctcatgcaggcgataccgaggacacagatgagacctccgttttggaggcgctggagagttcagagccatcgtcaaccttcttcccgaaaagctgcaagatgcagtttcgaaactggaaggacagaaagcgttattgagcagagcagggaagggtggagcactgtgctgaatgtacgtgcccgagccttcccttcacccattccgaatcccatgggggatggaggaaggcttggattatttctccctcacacgcggggatgtcatctgacttagcagttgatggtgactacactgggttgaagtgggtcccccaaaagatgtgttcaggttaagatgaggtcacactggagcagggtgggccctaatcgaatgactggtgtcctgataagaaaaggaacgcttggacacggacacgcagacagagggaagaaggccacgtgaagatgaaggcagagactggggtgacacaccttggagtcaaggaacgccaaagactgccggcagccctgcagctgcttctccctcccggcctccatagggaacctttccatttgccaacaccctgatttcagactcaagatttccagaaccctgagagaatccatttctgtggtttgaagccactgagtttgtggtagtttgtgacggcagccccatgacactcatccacagtgacagctaaggggcagtggtgacctgtccccagactgtctggtgagcggctcggaggaatattaatgaaaaggcatgtggttgtcatgttttttccagtccatggatctggggcaaggtgaggcctaggtaatgacaatctagcccctacctcatctctccagccaagcgtcttccggtaccaggaggggtctgtctttgctgcttcaccccaaagagatctgggccatatgaatgtctcaaatcatgtcctgtgtcatccctgaagtaaccacaatgctttgaggacccagaccaaaggcattttctaaatatttcaggcctactcttgactagctctaactccctctatcatcaaaactctcaaaaataaaaaatataatggttgaaattaataacataagaaacgggacaaacagcagaatcagctcggctgaagagctgggagatagggctgaggaatccattcagcagctgctgcttgagcacccactgtgtgccagactctgtcctgagcaaaatttgctgtcttcatggaactgcgttccagaaaattctctcagaatgtggcaggacaggataattatgtggaaagggtaaaagcaaagttcgaggcctggtgaggtccagaagtgcagacatctgtctccccctgtccagggggagttctggaaaggagaatggaaataatccagtaaagacagtacttggcaagatagtttaggattccagaaacctaaaaaagatcctcatgaaagtcaggaaacaggggtcagggatagaactacactctgggcatcagtgtgctacagcgagttcccggaaatccactgcaggcctggtcctacttactatttaaaagttaccagagagaatgaacccttaatgaactctgcagacttggcttgtgtgagtcaaagctgagccaaaggggctggagccattgagtggctctaagatggagaagcaaggaagagcccagtggaagggatggactgggcctggtgaaatgggaggcctctgcacacctttctggccaccatcaagtcacatcacagctgcgctttaatgaagcctgtaacctgcaggaggtggggggatttaggtgtgtgagcagcttgctgctgaggcccaatatgccagctaaggaggctgcctctgggcaggaccacagcacgtcccccctgaactaacccacaaactcgtgaaagctcttgaactcttggtcagtgtagccaaggagggccggcttttgttcttataggaagacaaattccagaggttacggtttgaaaatggagagatgaaggttgagaagggtcgagtctgaacagaagaggggcacacctagggtggatgtacctagggctcaccaactcctagagcgtctgaacgccaggagagcccctgaagctcggcagccatagttctagggccaccggaagggaagagcgcacggcacacagacgctttgggaaatgccaccctcaggccgagactataaaggattccagagggcacacctaagccttctgctaagggccagctggagctctggctggggctgggtcacacgctgagcctttcccggtcatttccctggagggtcccccagatgctccgcgggcttcttatcagagacatgattccaggtggggccatcactgcacccttctagggcacacggtattttgagtgggatctgctgatggtgttgcttacctgccggttcataaagacatagataacggggttgtagatagtggcacttttggcaaagtaggccggcagggcagccatcaaagggtggaaggcgtaaccagggttggcagcagcaaagcatgcgaagaaggtgtagggtccccagcagacgcagtacgcaaagatcatcaccaccaccatgcgcgtcacttccttctctgccttctgggtggattcagactctttctgctgctttgccacctaagggagacagggatagtgagtcgggggttggagggcagcaagaggcaggtgacccaggcatagggagttgtggggaggaggagaggagcccagcagccatcttccagccctgagtggagcacagccggccccaggcagacatggctgcctcaggctggccctgggggagttctagaattggaggtggcatgcagctaggtgtggcctaagatgaccccagagctggatctaacaagctcctttgcttcacctgatcccttaacagactgtcctgtcctgcgctcaggcctgagcatggaggcctgatttgattgatgactgggcgtggagaatgaaggagttaacaaggtggagatggcgggggaggcaaaagcagtggctggcggggtgcgcgatgggagtgtcagagcaatgcatacacttccctcaggcttcctaggccaggttggccactctgtggactaaatcctgccctggactcacggtgaggcagctgagggcagctttggtggggtggctccttcatgcctgctgggaggaaggagacgaatggcctccaggcagaggcactgtgggggaggccagaggccagccaccacctgccagggatgagggactggcggcaggcagatgagtggggatgagagagggagtgtgagggctggaatgcagggatggctgagacagcagagctggggccacattgtggagctggggctctaccatcccagactaatacagccgaagccatggttgggtacctgtgggagccttcaccccaaggtgacggggtgagggggcctttcacaggctcacagactcctctagagagagcttggcaggcatgcccatccaattgtgggcacaggcagcttcatataggaaagccagcaccctgaaagggctcccactgctaacagaaaagaaccagcctggctctcctcccttgctctgacttcctgaagggctcccagtggtagcctagtctaggggtggggggtgacggctgtggacaggatcagcttcccagggcagagggccagacatggaggtggagagtgggtcaggggggcaaatggcactctcgggtccactccttggtcggccccacagcctatgaaaaggacaagggtactccggtggcagcctcataaaaacacgccttgatttgcaggtgtcatttgctgatgtggctgctccactctactctgtgggaaaggcagcctttccaccccggggagaactgtccagggtcggggcaaggcacacctctgttcccttagtggactcctccagggagggagtggcagtgctttcccgtctcacagagctgaggacaacggggctggggctgaacctgcagccactggtacagtcccaaaggaatcacctgattctcatcgctggatcttaatattttcttataggggtaaaatcctcttctctaaggatttttggaaaaatagtttaggagtctcagtggactcatttgagggcagagcagcttaggggcaggaggcgggtgaggccaggaggaatcggggggcttaccgctcggatggccagccacacttggaggtagcagagcatgatgatagcgagtgggatgatgcagcaggtgaccatgaggacaatcatgtaagactgcaccccggggtacgagctgccgctgaacacgtctgggccgcatgaagtcttcaggccgtggggccagtacctggagagaagggccggcagccagtcctgatgcagggtggggtgacccaggacccccggcccaggcacggtgctaactcgggtggggtttgtttttttaaattgaggtgaaattcatgttgcatgagattacccaatttgaagtgatcaattctgtggcagtcaccacctctgcttccagaacattttcatcaacccaaaacaaaaccgttgggtaggattttggttaatccttgtccatttttagatgtcatgcctttcttctttttgaattgtggtaaaatacacatcacataaaatgtaccattataggccaggcacaatggctcacgcctatagtcccagcacatttggaggcagaggtaggaggattgctcgagcccaggagttcaagactagcctggatcacatagtgagatcttgtctctacaaaaaataaaaaaaattagctgggtgaagtggtgcacctgtaggcccagctcctcaggaggctgaggtaggaggatcacttgagcccaggaggtggaggctgcagtgagccataattacaccactgcactgtgccagcctgagtgacagagtgagaccctgtctcaaaaaaagaaaaaagtaccattgtgacctttggtacattcacaatgctgtgcaaccatctccactatctgcttccaggacattttcatcttcccaatcactccccttctttacaaagggattgtgaggttccttcttgccctgaccttctgagaacacccatgaagagctgagtcttttatctgaggtcagctaggccatgactgaaataaagggccctgctcacttagtggcctggaggattaaatgagataacccgcgggagagcctccaccagggtcagctcaccacacatgtttgataacgggcagctgtgtggggcatggcggcatgaggagggcgggagacagagacaggcttccacaaggtttgtttcctagaattgtggaacgttctcgaggaaagaacattccctctccaaacaccacgagaacttattcacgagcttgtcgataaaacagtgaaatgctgtcccacccagtccactccaatcaaacatttgagccacttgcttggcctggccaggacatgtgctctgtaggcccaggtggatctatgacccaagcagcctctgaaaggtggggggcgtggtgcggcagcgtgtgcaagaaagagacctggaatgcaaacacgctatgcgttcactgacagctgtgctgatggcctgagctccgtgtgcgcctgtgacctgatcgtgcttgggataaatatgtttccagaggttcggggaccacagagcctttcctatgttgcagccacattcatacattgatagacattgcacgctcagaggggcccagagaaaggaagtgatttgccttaaggtcacagagtctgaccctgcccactccatcttgcgtcctcgcacccttacctgctccaaccaaagatgggcggggctgtccacacagcagaccagatccaggagaaggcaatgcccacgatggccagcttggcatcaaatctcacattgccaaagggcttgcacaccaccagccacctctcccaggaaatgatggccagagaccagagacctgtgatccctatggggagagcagacagatgagggctttgagccaaagcaaaggtgggaagcaaagcttcccactgtcctgcttagaccccaaacgtctgcacacagaattcagggctccacggactgaggtggaaaaaacgacatctttctttccaccaacctcgaacagacactgggcatttccttccattatgaacgtggcagtattagcagtacccgtgactcggtcagcaagagaggtcacagatgttttcctgtcaattcatagaggtggcagagagttcgaataccacttatgttcatcactactctgaaataacagtggttgtcaggcgggatcctgttatttaataccttaatactgagtggtgtcactaatacgtttaacacatgcttttatttttatttactttttgagacagaatctcactctgttgcccaggctgagtgcagtggtgccatcatagctcactgcagccttgacctccagagctcaagcgatcctcccgcctgagcctcctgagtagctgggactactggtgtgccaccacgcccagctgtttttatttgttgtagagaagaggtctcactatgttgcccaggctggtctcaaactcttggaggcaagcagtcctcccacctcagcctcccaaagtgctgggattacaggtatgagcctggccagtaaatgcttttaactaaagactatgttactgatgaatgtttaatactttgataactgtatttcagtataatttgctgcctttgtaatcctatgggtctcattttatgcgtttgcaaaaattctcctgagatggggtccacaggcttcccagatggccaagggcatccgtggaccaaaagtggtggggaagtgctggctgcttggcacctgactgacccaagaacagaccatgagcagaggcaagggtgagcgggagaccatggcagaaacggagacagacgtgggcggagatgcagggggggcactcgggaagggtcgtgtgaccaccgaggccatgcctgctgcagagagcactcggacctggggatggaccttctctgcctgaccttcccttggctccccttctacactatcggggtagtgccgggacttggacaagcaccctctctggtctgggccatcgtgggtacaatttgaggcagttaacggggtggggttggggaggctgctaagagtggtggggaggcaagagcaggagctgctgctgctggatgtggggtctcctcctcctgaaagaaagtcccagctcctgggcatgacgtctgaggcctctgagacctgggcctgcccacctcgtgtccagcagccacggctgcttggtggtactctatccactcgaaccacaaactgctcccagccgctcctccaccacctgccccaggccccttcttgtctgagaggactgatgatggtactgtgtggttgccgtctggctatagggccccctccttagcacagagcctggcacgctagtacctctcggccactgtctcctgacctgagcggaatagtggcccacagagatattagtgatggggatggggagaggatctgggaattgtgtctcctccgggaaaagcagatgctggcgagctgaaagagcaggcatccctaattgcaggggagttctgtccagggtgcccagagtccccgcccccctactgttctggggttgtctagctctgtatctgtctcctcccacaccagccccacagctccaaactggctgtccccgggcagagcctgactcaagagtaggaactcagggtatgtttgactcaagggagctgaatttaatgtgagtgttcagatggaagcctccagaacccttcagtatatggatgtgaggcgcagatgtggagggagacaggcctacaggagcagctgggccccgatcatcatgaggtggctggaggagcttgcagggtgaatgagtggtttccgccgagcctgggccccgactggcttaccacacagggagacggtgtagccctccaggacacacatagggtggcccagcacgaagtagccagagacctggttcacaatgctgatagtgctggcgatgacggtctctgctaggtcagcgaccgccaggttcaccaggatccagttcagcgggtggcgcagcttcttgaacttcatggtggccgccagcacaagcccatttgtgaagacggatgcagtgaccacaaagatcatccagacactggtgaggtggtacacccatctgggagcgatgtggtaattcgggccttcgaaggggcctgagggcaggaggcagaggagagagaggagctgggctgcagcaccgcctgtctataccagtgctgatcccacctctcccctcccccttccgccctcctgcctttgcaattggctgtttccctccagctttgtccatcctcagacagtctcccctccatcctgtccctcaagccagagaccatcgcccgctggtcactggcactggcatcttgaacttaacagaactcctcatcgtctcctccatctgattccccactcccagtgtgcagtcaccccacttccctgctcccctcttccctttgccccagccccacctcctacctcccacagtcctctgcccttccatagagaaacgcttgcctcctgtaaagcccagctcatatgcatttgccttccagaagattccccagctagtggcaactcacccccttgaggggaagaccactacccacctctgtcaccttctgtcacacataggagttactgttcatgatgatctgaatgtacgtgccccccataaatttctgtgttgaaatcccaacccccaaggtgatggtattaggaggtggggcctttggcaggtcatttaggtcatgtgtgcagagtgagtggggccctcatgaatgggattagtgcccttataaaagaggtcctagaagctgggcatggtggctcacgcctgtagccccagctactcaggaggccaacgtgggaggatcacttgagcctttgggaacagcccaaattagctgggaatggtggctcatgcctgtaatcccagcactttgggaggctgaggctggagggttgcttgagcccaggagttcaaatccaacctgggcaacatggcatgcccatgtaaaaaaaatttttttttaattaaaacaaacaagaaaaagagtccctagagtgctctctagctctctttcttccatgtgaggatacaatgagttgttggcaatctgcagtcaggaagagggtcctcgccagagcccaccacgctagcaccctgacttccagcctccagagctgtgagaaataaatttatcatttaaaagccacccaatctatggtaatttctcttttattcttttcctttctttcttttcttttttttttttttgggacaaagtcttgctctgtcacccaggctggagtgcagtgatgtgatctcgggtcactgcaacctccgcctcctgggttcaagcaattctcctgcctcagctccggagtagtagctgggatttacaggcacccaccaccacacccagctaatttttgtgcttttagtagacatggggtttcaccatgttgaccaggctggtctcaaactcctgacctcaagagatcctcctgccttgtcctcccaaagtactgggattgcaggcatgagccaccatgcacagcctggtaatttatttttcttttcttttttttttctttttttttgagacggagtcttgctctgtcacccaggctggagtgcagtggcacgatctcggctcactgcaagctccgcctcccaggttcacgccattctcccgcttcagcctcctgagtagctgggactacaggcgcccgccaccacgcctggctaattttttctatttttagtagagacggggcttcaccatgttagctaggatgatctcaatctcctgacctcgtgatccgcctgcctcggcctcccaaagtgctgggattacaggcgtgagccactgcgcccggccacagcctggtaatttcttatagcagccagtactgagacacaagtacaagtcttgtctttctcaccagagactttgactcattcatcctcacagagtgtccagcacacaatagatgctcagaaaataaatgaatgaggaaattaatcaatgaatgtgttatgagttgaattgtgtccccacccaaattcatatgttggagtcctaaccccaatacctcagaatgtgaccgttttcggagatagggtctttacagaaatgaccaagtttaaatgaggtcattagggtgggccctaatccaatatgacggctgtcctgattatgattatgattattatatatttagagatacagtcggctgggagcggtggctcacgcctgtaatcccagcactttgggaggccgagggggtggatcacttgaggtcaggagttcaaaaccagcctggccatggtgaaaccccgtctctactaaaaatacaaaagaaaaaaaaattagctaggtatggtggtgggcgcctgtagtcccagctactcaggaggctgaggcgggagaatcacttgaacccaggaggcagaggttgcggtgagctgagatcacgccactgcactccagccggggtgacagaacaagactccgtctcaaaaacaacaacagcaacaacaacaacaccaaatagagatagagcctggctctggcacccaggctggagtacagtggcacaatcatagctcactgcaacgtggaactcctgggctcaagcgatcctcctgggctcaagcgatcctcctgcctcagcctctcgagtatctgggactacaagccgtgcattaccacaatggcaattttttttatttctgtagagatggggtctggctatgttgcctaggctggtctcgaactcctgacttcaagtgatcctcccaccttggcctcccaagtagctgggactacaaacgaattatttctcctttttcttctgtaggagtttgctagggctctacaccttttgtgttggaaggaccttcgtcataacattgtttttggcagattacttgaagggattgcaagccacagacctgctgccatataaggcctcatggagagtcccaaggtttatcaagagattctttagctgtgtgttagaaaagcccaactcaagctagcttaagaaaaatggggatttcctggctatggccaggagagacagataaatctcacccctagcacagctggatcccacaaggcctctgctgccctctgtgcacgggccccatatgttcctaacacaaggagcttctggaaacccacagacaatgtctgcaatcccgatacctggcactggctccccaggaacccccagtatgagcagcagggacagaccattgacaattgaagacctgcatggcgtcagtctccgtgcagaaggaagcagaggggagcaatggggttgctgatggacctaagaacagagaacccccaaactgtcggcagctcttccctgggaagtaccttgggtgaactggggaagagcagctgagactgggagggtttgggacactctggcctgcaggcaagtgcaaggggctggagcaatctaggtgctacgacctctgaaaacaaggcagccagtgcccttccctggcaacccttgcggtccaaattgggcagtgcagggacaagggggcaaaggagagaacaggtcccagcagcagtgggggaggggacaggagctgccaccagtgtaactagagctggtgtcatggcctacccctccctcctgaaagttctggaactgaatttcatgaagcaatgagcaagagaatcaaagtcaactcccaggcaaagtgattcgaggaaatacaggcaggtagggaaggggcggtcggtggtggcgcagagaagccagacttcttcaaatacaccttcttttctagattttaatttgagacttttaactgttttattacataattataaaacaaaatttaagtggccgggggcggtggctcacacctgtaatcccagcactttgggaagccgaggtgggcggacgacttgaggtcagcagttggagaccagcctggccaacatggtgaaaccctgtctctactaaaaataaaaaaaattagctgggcgtggtggcgggcacctgtagtcccagctcctcgggaggctgaggcaggagaatcgctcgaaccgaggaggcggaagttgcagtgagctgagatcgcgccactgcactccagcctgggcgacagagtaagactgtctcgaaaaaataaaataaagtaaaataaaagtttaaatttacagagcaatctctgaaaatcagcaacaaaagaaatgaagctaaatgcatatccactgagtggcatatcacttagagagggactattctaagggactggaaacacaccggtttactacacaacctagtggcatataccctcagggtaagaagacctgtgaagatgttaaggttttggtcaccaataggtgaaggcagggtaaggtgtccgaatgccgtcattttccatccccagtggtttaattggtctgggcattgagtttcagtagctgccaacaccccagaaaagagacactctccttgccaaaacacaccaacaaatccaacctacctctggccagatcctcagatcaactaccaatttacagaaaaatcataatgaacaacgtcagaggggcctgttaggctacgtcatgaacgacttgcttgcttccacaaataaattgcagggagatagaaagggaacctctagattcaaaggtagtcaaaaggcatatcagtcaatctgaatgtgtggaccttatttgagccctgattcaagcagactgaaaatacgtatgacattttttgaacactactaggatatttgaagctattcaggaaatactgttacacttgtcggtgtgatgatgacttgtggttatgtattgagaagagcccttttctcctagaggaacatagtaaagatttacagagggaagggtgtgatgtcttggatttgcttccaagaatcaggaagaaagggtagtggaggggtcacagatgaaatgagatgaaaccgtggaagctgagtgatgggtaccggagttcattacactcctccctctactttagtagatgcttgaagttttgtggaaaaaaaaaaaacccaccccgacatttgaaaagagtgcactgaagcatcatgcattgatgaagtctgggggcatctaggaagagactgttgacattgccaccaaggaaattctgggcacagtcatgttgaggtcaactgcaagatcctcatccggtttggtctgggcactctgtcactaattggcactcggtcctggccaccccacagcgggatgtttattggcaatcaaggagctggcgtggcttctggaaaccacagcctgcacgatgttgttgttttttgttttgttttgttttgagacaagagtctcactctgtggccaggctggagcatagtggcgtgatctcggctcactgcaacctccacctcccgggttcaagcgattctcctgcctcagcctcctgagtagctgggactacaggcatgcgccaccaagcccagctaatttttgcatttttagtagacatgaggtttcagtatgttggccaggatgatctctatctgttgacctcgtcatctgcccgcctctgcctcccaaagtgctgggattacaggcgtgagccactgtgcccggcctgcacgatgttcttgaaggcaccaaaggaatttggtttggaggagggacctggggagagggccaggagtggggcggtcactggtgtcctcagcttctttgagggcctgcgtgcaaaactttcggattgggcaactcccaatggcaggactcgggctgccctgatgagagctttcagctttctgttgggcctgagccctctctcccaggacggctccgaatggaaagatggccctgggcgccaatgcagcctcttcccccagaggtgtgcagccaaaagccaagtggccccatcatggagtttgacaaaatgactgctacaggctttgccgaccctgaagttctagaagtttcttgccctctgctgctgtcttccccaccctcccgcctcccttgggtgtgtcagtatgttgcctctttcggcttcaaatgtaaagacagacccagctcttccccaggaagctgagggactccgtggaatgagaggtcattcgctagcagtgaacacactcatctacgggccacaaagaaagagcacataaactcttccccggcctcggattctcaaaggggctgggaagcctgtgtggcttgagaatgcatattcgatattatggtgtccttctagatttggagaggaccccccaattcatgtcatcagaaaagctatgggagaaagccttctctgctggtggggacgtgcagaagagagattcccttgggcggggcaggtgggtggccggtggcccccagtgcagccacccagcctccacgggcctgctggctcacctctggtggagttgctgttggtgtaggtgaagatgctggactgggtgctgtcctcatagctgtcctgcggatggcggcctgcgagcctttggaggctccactgctgggccatggctatggaaagccctgtccccgacggcagccggccctggcgcatcacctgagggtcacggcgctttatactggcctgtgggatcagcccgggcctcttcaccttaaaagctcccaaaccctacactacctgatctcttaattgggcctgggacttagacctcctcctcccacctcttgctcccctgctcctgaggcgagcccgcaagggcggctcagagggatttgctgggaaccaaactcagacgccccacccatccccgccaggaaggtggcggtgactgtgggagccgctgtggccctctctgtgtttatgtgttctctgttcccttctactgtcctgcgtccgcctttggggcaggtggacccacgggtcaggatttgcagactggggggtgggtggtgaaactgctcagagcccgaatcctcctttctcatgtggttctcttgaaagcccagggagactatttagggccgaggcctggaaccggatcctccttgcgaggccagccatgtccgtgggcccaaacgggcgagatttgtgccggggggctcctcctccagtgtagggggggcagactgactgcgcacatcctgctgttggcttccctcctcccccttgccccccatgagctgtaggtcctttggccgccagggtgcacatgcagtgcccacatcagcccacggcagcgcctgctcacgtctcccttgccctgagttcacagccttgccttgggcttcaccaaccacaggccccccgtcgacagagtgtccagacaggccatctctgctgtccctgtgtccccacgcttcgcaggggcacggatgacctgttagtgcccaactccgtagcctcgcctcagtttccaaccaacgggccctgtcccctccacggcccacccgccccagcgcctccccaggagcacatcccctttcacggcttccatcagctcccagctcctcagtccccaaatccagctccttccaggtacctccttttgggtttattccttaagcttaggaaagccaaggcgtgagcttgtggcctcttgtccctgttctcagagccacgattctccagcattcctggctcacacttacactcctggcagcatggcttctgctgcaggcacaagggggccctggctgccaagctgaaggccagggctgcatggagccccagcctggctacccatagcaagaatggcttttaacatctgtcgctgcctgccacgtgctaggtgccaagctaggggccccatgtggaagagaagacgagtcctggccacagacttgccagggcccattcacagcctagaaaggtgagctttttccccaactctggcacttctacacctgtgtacccaagagacttgaaaatgtgtgtccacacaaaaacccgtacatgaatacaaacagagcactgttcccaacaggccacatggtagaagcaacccaaaagtccagaagcagatgagtgggtaaaaagtggcctgtctgtacaatggagtatcatttggccataacagggaatgaagggctgacctacgctacaacgtggatggacctggagaacagcatgctcagtgagcgaagccagacacaaaagaccacggagcgcatggctccatctctgtgaaatgcttagatagggcaatccagagacacacaaagcagaggaatgggtgccaggacaggggagggagggaaatggaggatgacttcttaatgggtacagggagtgctttatgggtgataaaaatgtcctaaaattggattgtgatggcgcagccactgtggaaaacagtttggcagctcctccaaaagttaaacgtagaattcccataggacccagcaaccgcactgctgggtataggcccagaggaatggaaggcagggtctggaagggctgtttgcacacgcatgttcacagcagcgtgattcacaacagctgaaacatggaagcaacccgtgcccatcaatgggcaattgggctggacatggtagctcatgcctgtaatcccagttctttgggaggccgaggtgagaggatcacttgagcccaggagttcgagactagcctgggcaacatagtgagaccctgtctctacaaaaaatacaaaaattagcagggcacagtcgcaggtgcctgtagtcacagctacttgggaggtagagaggcgggaggatttcttgagcctgggaggttgagcctgcagtgagctctgatggcaagactgtctcaaaacaaacaaacaaatcaacaaacatcaacggatgattagctacacaaattgtggtctatacagacgatggaatatgattcacccttaaaaagaaatgaagtttgacacatgctccaacatggatgacccttgaggacattgctcagtgaaatgagccagtcacaggagggtaaatactgtaaaattccacttatatgaagggcctagagtggtcaaatccatagagacagacagtggaagggtgggtgccaggggctggggggtggggagttggggttgaacggggccagagcttcagtttgggaagatgaacaagttctgcggctggatggtggtgatggctgcacagcaccgtgaatagactaaaaaccaccaagtgcctttcttcctcttatttgtttttagggcctaactcctaaagaggtccctcctgcagaaagacctccctgatggccttggccttgggcccctgctctgaagtcccctctcggactgcatcctgcctctgtggcagtgcttcagctgggaccccttgactttccaccctggctgccagcagcatggtgtgtgccccgcactccttggcaagatggaatggtcactgtccctgttctgtggatgagatgcctgaggtgggttcaaagtatagatctgctgaaacagtgtcaagactctagaactcaatcccaagtgacttccaagggtccctcttcccgggtccaagagagcttggtctgcctgtccccaccagagtcagaggatccgaggatccaagaatgtgagacccagaagtgagcctcctctgagatcacctgccccaccgggtcccttctgagggtgggatggctggccagccttgtcccattaccgccatgagctggctgggtggccttgaacagggcgacctctccctcttgaccgagattccccttctgtctagagggagataagcaactctgaggcttccctgggcatccaaggccaccatgctatttggaagccctttgagaacacgaagtgccctatgaagtgggggtccagcagaggaggagtggggtgtctgggggaagcccccagccttgcctgagccccggagctggccctccgctcgccctgtctgcccttgtccaggattacgctaatgacccagctcagtgcaatcccaccaatgccctgggccacacgtgtgccagcccccacatcccaggaaggagagtggaggtggcagaggtgggaggaggcctggaaaggcggtaggttctgcaccttcaccggctctgctaattgatgattagggctaacagaagatcaagtcccattttagcctaaagcagattactgtcctagaaagtcactcagcacctgtgggggcacgtgtgtccccaggccaggtgaaaactcatttgtggtcccacactcttgcagaagggtggatgaaagtggagggagcactagagaaggatatgaagaacgagggggtgagggggtgggatggggggagaggagcgggagcagtggcggcccaagaaagccccaaggaaagagggcccctggggaaaggccagagggacccaagccaggccgggccccaatgtcagcgccctctgctctgcccggagtctcccaccctcgctgccagctggggccctggccagggtggaagattagatgttggacttgtctctaatgcgactactcctaaatgactccacgcgggagagccgattaggagttatgggggctgctgtcatcttgactcaggggctttgtcactaacagccgatggctgctacagctataggacaaggaaccatttggccatttgcctttgacactttaaaaagatcgtggtaaaatatacataatacaaagtgtaccatcgctaccgtgtgtaagtgtatagtccagtcaccaccatccgtctccaaactcttttcattgcatgaaacggaagctctgtcctcatgaaacacccatgccctttccccacccctcagcctcctgcacccacccttctattcctatgcatttgggagctctgagtgcaatcctacgggtgcatggccttctgtgcctggcccggatcacttatccgttgcctttgtgtatttggaatggatatccaaccattggattttcatttttgtgtggttaaacatcatttgttccctttttgacttctgaccttcctacctcgtttgaagaggtccgtaaacgcacaccgtactccgccctctgccccagctgccgggctctccacacttgccaaggccccctactcggtacagtcttgatattctcagctcagcctcataatctcaccctggctgctgtaggcctcctaagtccctgcccgtccagccgctctaagtcacagagtgtgaatgtggcacgtccaccctctgtgtccttgagcgtggtggtcactgtgtcctcatcaggaagatggggataacatttacttgctgtaaggcttaaataagatcatccttttaaagagtcttagctcagtctttggtacagaaaactcagccaattattcattcagtgggtacttattaggtacttttgtacctgttctaggtcccgggatgcagctgcagatggagatcccgtgctccgcagctgcagctgcctttctagttgggggagatgagtaggatggagaacagaaaaaggaagacaggagggtgcgggtgccagggtgggaagggagtggatgcccactttcgaagggcaccagggtgagcccctctgagaaggggacatgtgagcaaagactcgagggagggagggcaggagggagccatgcagagatccaggagggcatcacaggagaggggcagcaagtgcaaaggccctggggcaagagcgtggctggcctgctccaggaccagcaaggatatcaagatggctggagcgagagtggggttggtgaataggaggaggaaaggctgcatggcggggcccttctcactctgaatggaatgaggagctttgtcggattttgaaagaaaaagtgacgcaatctgaagttgattcggatggactcctctggcagctgtctgcgagctgtaggggccagggcagaagcggggagaccaggtctgggaggcgacagtagggtggtaagaggtagcagactctggagagcttttgtaagtggagtcaacaggatttcctggtggcttaggtggaagcagcgagaggacaggaggagttgccctcagctgagaagtcgaggttgtgggcatcaggcatccataaataacgaacatggggactggcaaggggccctcgcctcacagccattgacatccttcacagatcctgactaatgtgaacatttggatggaatggacaaacttttaggaaaacacaacttaccaaaatgggctcaagaagaaagaatcagaagagttgaagtcgctgaacctttcatgtcaaacctgcccacaaagaaagggtccctgttccgtttctgacctttgcccaggttgacattgattctgagcctgtcatgtctttctttctttgtttctgacatgtcttttttttttttttttttgacgtggagtctcactctgttgcccaggctggagtgcagtggcgcgatctttgctcactacaacctctgcctcccgggttcaagcaattctcctcagcctcagtgtcctgagtagctgggactacaggcatgcaccaccatgcccggctaattttttctttgtatttttagtagagacagggtttcaccatgatggctaggctggtctcgaattcctgacctcagctgatccacctgccttggcctcccaaggtgctgggattacaggcgtgagccaccgcacccggccattgccttgtatttttaaattggtttttcttctttgacttgaaaaaagtcttatttccaaatctgatccacctttacaatctagtccagagaatttccactgtaattaaactatttactgtttagttataaagagccttcaaaaagatatatcccccaaagcctgtcataaaaaaaaataactatctgattccatttatatgaggttcctacagcagtgaaattcagtgaatagaaaatcaaaaagtgtgagctaaactccaagcaggcccaccaagtatttgtttggctttgagccagtgccagtcacgtcttctcaacctaatggaattttttgtcgttgcccaccggaggcccagatggactctcagctgggagcaggtgggtgggagggggactcgccttgaacctcccattgagagcctgcctgctgggtctgtgctcccctccccatggcaggcttctcttctcacgtcgtattatgttccaactgggttgttcatatcgtaggacaaagaaaataaggaatttgtgactgggcccaatggctcacgactgtaatcccagcactttgggaggctaaagtgggagaatcgattgagcccaggtattggagaccagcctgggtaacatagtgacaccccatctctaccaaaaatttaaaaacttagctgggcgtggtggtgcacacctgtggtcccagctactcaggaggctgaggcaggaggattgctggaggccaggaggtggaggctgcagtgagccatgatcctccagcctgggccatacagcaagaccctgtcttgaaaagaaaagaaaagaaaagaaaaaaagaaaagaaattcaaattcacttcatggtcctgatcttcactgtaagcggaaggagagagacataatgggccatgttaattgaaaactgcatgcctagatttctttattaaacgcatgtttcctagcactgtccaaaaaaaaaaaaagtgcgaggcgaatccggagcaaggctgcggcttcggaaacggctgggcaaacggccgtgggacccggagccccagaacagctcccagcggtgagctgaacgcctctgcgaagcccctgcctcgggccctgtgcaacgctttttccggtgagcggcggcggcggctcggtcctcttgctctgtgggtcgctttgctttgtctcagtgccttccgcactttggcctttgtggattctggttctcactgttgacaggtgggcgccttctgtctgccttagcacggggacccccgggaacgcgggaaggcccggggtttggcctcctgttcggctcccgggcgccctcttctggcgccgcctcgccgctcgcgcgtcaggaagcccccggcggccgccgcgggtcctcgggagttctcctggggctcgcatctgcccccatgcgatcctgagcgggcctgggccatgtcctgaaagggtggatcctggtcgggaccgctggggccctttgtagtcccctccctgctttgtcacatcctagcgctttctgatggcacaggttctggtttcctccagtatatcaaggaggggggctcattcattcttcctgtgtttggacttcttttaggagaagtgggggaattcgggttttcgctgccttcctactcctgcctgaacccagaaatcttattagccttttttcttaaaaacttttttttaatagtggtaaaatacccataacatacaacttaccatcttaaccgtttttaagtacacacagttcggtggcattagtgcattcacattctcttcagtatcatttttgtgttaaaatcattaattcagtgtgtggtccagccaagtgtttatttttttaattttaactcttacagacagtggaaatcagacaaaagcttaatttatacgatacatatgcaattaaaataccaagatttgcacatacaatgacatgattccctttaactgtctttcattgctagggaagaaatttctaacagaatcttagtgcactattagacagcactatttcctgtcattcagggacccaggtgtttttcttgcacgcatttcctgtgtatttcctttatctgttattgtgtgtattccattgatctgtctcacattttgtacacaatgcaacaagagatattatttgcttccattgttctaaaaagctttctactgcctttgaacagaaaacttgtccccactctgacggcagcccctgtacatctgggtaaggctgtgaccctccaggtcatcagtgtaagctctagcacattctctcccctctcaagttccatccttgttctgcaaggctgggtgtcttagagtcttggatctgatgatttgagctttgcatttacaagtgacatttctggtgacattgtacttacaaactcggtgtttccaattatagcatgggaggcaagaggaccaacttggattcactgatgcaaataaccgctttgttctgaagccaagcagcccgtgggcagtggcatggcacagactttagatgttggtcacattccctgcccagtcataaactcacttgaggttagtcattgatgtaatcatttgaacgaataaaagtcaagatgaatatgatctcaacccatactcctctatcaaagatagctgtggttttctaaagcgtaacctatttgctatacaagcattttcttttgtttttcttttcttttcttttttttttgagatggagcttcactctgtcccccaggctggagtgcagtggtgtgatctcagctcactgcaacctccacctcctgggttcaagccattctcctgcctcagtctcccgagtagctggactacaggcaagcaccaccatgcccagctaatttttgtatttttagtagagacggggttttgtcatgttggccaggctggtctcgaactcctgacctcaagtgatctgctcgcctcagcctcccaaagtgctgggattacaggcgtgagccacctcgcccagcctatacaagcattttttacattgtgatactatctcttgccttggaggcatctaggatctaatgtggtcctagatgtcccagctgcactatccagcctgcacagacctaacctgttaaatggagaaatagagaaagggcaagaggacaagacgtcattgtatgactattagaaatagtacactaaggatgatgccaaaaaatattcctggacagatagagaacaagaactgtctcttcctcatccatttcccttgttccctgcaaatcctttgtaattattacttattctgctgggggaataagtaggggccagcagtcttcctccatgagtcgagtctgccaggcttttcaggttgcgacctgctccccagagcttaccatactctctccatttggtctggatctcaagtgtagagctgcctaacaagcccccccaaaatttagtggcataaaataacaattgatgagttcttatgagtttatgtatcgactgatctgtaaggcacagttcttctgctccacctcgtgttggttggggtcactcatgccatgtctggcagttggtgctggctgttagctggcttgtattactctcctccacatggcatctcatcctgcagggcctctctctccatgcggcctctcaagcaggatagcccagacttcttcctatggtgctggcttccaagagggcaacgacagaaactgcaatgcctgttatggcctaggcctggaagtcacctaatgttccatctgccacatcctagtagtcaaaacaagtcacaaggccagctctgattccagagaaggggaaaaagcctccgcctcttgttgggcggagtgccaagtaatgctatagaaggacatgcagaatgggagccatgggagcagccatctttggaaacaatctacctcatccagtgagaggtgttccatccattcccatgtttaagagaaaaccctaggctgggcactgtggctcacgcctgtaatcccagcactttgggaggccgaggtgggtggatcacctgaggtcaagtgttcgagaccagcctggccaacatggtgaaaccccgtctctactaaaaatacaaaaattagccgggtgtggtggtgggtgcctgtaatcccagctactctggaggatgaggcaggagaatcacttcaacctgggaggcagaggttgcactgagctgagttcgtgccattgcactccagcctgggtgacaaaagcgagaccctgtctccccaaaaaaaagaaagaaaaaaagagaaaacccaaggaacagaaagaagttggtacagccttggcactgggatctctgatgggaaagtgggggtctatgacagtggcgctgccactttccaagtattggtgtccacattgtcaccacttgataaaccttggtgttgatgcgttctagcccctgcattcacaccaaggtacagcttggctgtacaccatgaccctgtcctgctaggccacttgtttctagctatcttgggtctggaaatctccattttgtgagtcactaaaactattaatggacaaagagattttaaagctcacaatacaatctttcagaaggtaaaaagtcatcgtgctgagagcacttgtgttagctcttgcataaaaaaataaacatttaaaattcatcccaagaagttatgcattaccaaaatattttgtgtttttgttgttgtttgagacagagtctcactctgtcacccacgctggagtgcagtggcacgatctccaatcactgcagcctctgcctcctggtctcaagcgatccacctcagcctcccaagtagctgggactacaggtgtatgccaccatacatggctaattttttgtgtattttttgtagagatgggggtttcaccatgttggccaggctggtctcgaactcctgggctcaaatgatactcctgccttggcctcccaaagtgctgggattatagttgtgagccaccacgcctggccaatatggtggtttttaattaaagtgaaaatcacataacataaaattagtcatctgaaagtgtacagtgtagtgacatttagtgcatttactaatgcacgttgtgccaccatcaccactatgtactttcagaatatttcatcatgccgtacagaaaccccgtgtccattacgtggccactccccatcccctaatccctcagcccctggcacccgctaatctgctgtctgtgtctatgaattcctctattctggatatttcacataaagtggctcatctgatatgtgacttttcatgtgtggcttctttcactgagcaaaatgcttttgaggatctatctgaatttcagcatgtatcggtacttcattcctttttaccgaaacacattgaaattagtgacatttttatacatttacaggatagtttttgtttgtttgtttgtttgtttgtttgttttgagacaggatcttgctctgtgacccaggctgcagtagtggcacgatcacaactcactgcagtctcgacctcctgggctccagcgatcctcctgcctcagcctctcgaggtacctgggactacagccacacaccaccatgcccagctaatttttgtattttttctgtagagacagggtctcgctatatagcccaggctggtctccaactctagcttcaagcgactctcctgccttggcctcccaaagcactgggattacaggtgtgaaccactgctcccaggctgcagggtagattttttaattccattgagtcacttttcgtaactacaagcctcattcttctcggcatcagcctttattcgtgtgcaccatacagtgggttacccaagccaggcaaaggggcaaacctggatggtcccaagcagccaggtaccaaacacggtggtccgaagacccttgtcagtgttgttattaatttgaggactgatcttggagaagtccagtaccaaagagagttgccaggagacacgggtcagttgcttaagagaggagcacagctgccctagaacaagaaaggcccatggccttgacagtgtaaccagagtcccaatatttgataacaacacacaggagaaggtaacatggtaagcagtgggaattttagctcctccacaaaggaagagcctttgctctttgttctgttcgattgcttgttctcttataattggctgcagttatgaaataaccatgccaaggggcagcataaaagcacctctgttaacagatttgcagtgctgtgagctcctagtagggtgagaaaaaaaacctctggctctagataggatacttgaggttgaaaatatattgattacttaaagaccctttactcccttgcgcccaggcctctgcactccatcatacagaaactttaaaaaacattcattgatgtaatacacctctatgtatgtttatgtaaacatacacttatatgcagtcacagtaaaagatgttcacggccaggcatggtggctcatgcctataatcccagcactttgggaggctgaggcagacagatcacctgaggtcagaagtttgaggccagcctggtcaacatggtgaaaccccatctctactaaaaatacagaaattagccaggcatggtggtgtgtgcctgtaatcccagctacttgggagcctgaggcaggagaactgcttgaacctgagagacagaggttgcagggagccgagatcacgccgctgcactccagcctgggcaacagagtgagactccatctcacacacacacacacacacacacacacacacacagatgttcaggtagtggtattatttactgctttaaaagtttaggttttatagtaaaaatttaaaaatcaggcataggttgggcgtgggggctcatgcctgtaatcccagcactttgggaggccaagatgggaggattgcttggaggccaggtgttcgagagtaggctgggcaacacagcaaggccccatctctacaaaaagtaaaaatgcaaaaattagcagggtgtagtggcacccgcatgtgatcccagctacttgggaggctgaggtgggaggatcacttgagctcaggagtttgaggccacagtgagctaggattgcaccagtgcactccagcctgggtgacagagtgagactcggtctctaaaaaaaaaataagtaaaaattcaggcatagcacaaaacaatgtttagactacagtgattttctgatttatgagtgttgtgtggcaccattgtgtttatgcatagactagaatacatatatgtcagaaataactgtgtgtgtttgcattttgtctttatgaattttcattcctttggagattatccaggtaaatatacttgctaattacctcaatttattgtctaccccaggtatcaaagtcagtagatgagggaatcttagaaattatactaggctgcctgggcgtgttggctcacacctgtaatcccagcactttgggaggccaggtgagcggatcacgaggtcaggagttcaagaccagcctggccaacatggtgaaaccctgtctctactaaaaatacaaaaattagctgggtgtggtgcgcacgcctgtaatctcacctactcgacaggctgaggcaggagaatcgcttgaacccaggaggcggaggttacagttggccaagatcatgccactgcactccagcctggcaacagagcaagactccatctcaaaaaaaaaaaaaaagaaaaaaaaagaaaaaaagaaatgatagtagcacaatatgatcacacttcatgaataaaatttgacaaatatgacactacaatttattccgtttacaaggtggagtaactttgtagggctacacaattactgctattgttggaagtttaaaaggttgattttaaaaatacagatattcattattataactcagtttagctcaactcgtgtttacatttacaaaaccttagatatttagtgtaagaaatgctgacgtacgtgatctgcaaggtaagtattatgggtttagaaaggtcaacataataaaatttctcatgagaaaatcataatggatacatctcaaatcttgcaaaaaccaaagcacagtgttcccattgtcacttttacatacttcgtactgtgataaaactggagagaagacaaagacatacagctatttcttaaatgaagaataaaacaatttaatctattcaaggatttttcttataaagaaatattgaggaaacctggagttttagattattttcttggctttatttgttttttcttgatacattgtaatcatgcatatttatggtgccaattcatatcacgttgcacaatgacccaatcacggtagttagtgtacctatcacctcatgcaagtatcatttcttgacaatgcgaacatgcaaatacctctcttctagctattttattttattttttattttttattttttgagatggagtcttgctctcttgcccccaggctggagtgtagtggtgcgatctcagctcactgcaacctccgtctcctgggttcaagcgattctcctgccttggcctccagagtagctgggactacaggtgcccgccaccacacccggctaattttgtatttttagtagagatggggtttcattatgtttgccaggctggtcttgaactcctgacttcaggtgatccgcccacctcggcctcccaaagtgctgggatgacaggcctcttctagctattttaacagtaatatgcaatatcttactgttaaccatcatcatcccactgtgcacagaacaccagaacttattcctcccatctaattgttattttgtactgtcgacgaacctctccctgtgctcccttctccagtctctgtgcttctaagatatcagccttttttgttttgtatacagacagggtctcactctgtcactcaggctggagggcagtggcatgatcctagctcactgcagccttgaagtcctgagctcaaatgatcctcccacctcagcctcctgagtagctgggactacaggctcacaccaccatgcccagctaattaaaaaaatatatgtatatatatatatatatatatatatatatatatatatatatgtgtgtgtgtgtgtgtgtgtgtgtgtgtgtatatatatattgtagagacagggtctctctaggttacccaggctggtttcaaactccaggcctcaagggatcttcctgccttggcctcctaaatcactgggattacacttgtgagccactgcacctaccctcaactctttaaaaaaaattccacatataagatcacacagtatttgtctttctgtgtctggctaatttcacttaacatgatgtattccaggtttattcatgttgttgcaaatgacaggatttcattctttttatggttgaatgggattccgttgtgtatagataccacattttctttatccattcatccatcgatggacacttgggttaattccatatctggctactgtgaataatgctgcaataaacatgagggtgcagatctccttgacacaccatttcatgtcctatggatatatacccagcagtgggattgctagatcagatggtagttagctctatttttaatttcttttttctttttctttcttttttttttttttgagacagggtctcactgtgtcactcaggctggagtgcagtggcactatcacggctcatgcagcctcaaccttctgggctcaagcaatcctcccacctcagcctcctgagtagttgggactaaatgtgtgcaccaccacgcctggctaaattttttaatttttttttttttttttttgagatggagtttcactcttgttgcccagggtggagtgaaatggcgtgatcttggctcaccacaacctccgcccctgggttcaagcaattctcctgcctcagcctccctagtaattgggattacaggcatgtgccaccacgcccggctaattttgtatttttagtagagacgggatttctccatgttgatcaggctggtcttgaactaccaacttaaggtgatccgcccacctcggcctcccaaagtgctgggattacaggtgtgagccaccgcgcccggccttaatttttttttttttaattttttgtagagatcgggtcttgttatgttgtccaggctgctctcaaactcctgggctcaagtgatcctccctcctggcctcccaaagtgctgggatcacaggtgtgagccaccgtgcctggccgattttaaatttcttgtgcctcatattgttttccaccaacaccaagtgttcccttttctccacatcctcatcaacacttgttttcttttgtcttttaaaaaatagctgttctaattagagtaaaatggtatctcatggtggttttaatgtgcgtcttcctgatgattagtgatgttgagcattttttcatgtatctgttgcccatttctgtgccttcttttaagaaatgtctattaaggtcttttgctttttttctgagacagagtctcgctcttgtcacccaggctggagtgcagtgacgcgatcttggctcactacaacctcggcctcccgggttcaagcaattctcctgcctcagcctctgggaggcaggattacaggcgcctgggattacaggcacctgccaccacgccaggctaatatttgtatttttggtagagatggggtttcaccatgttggtcaagctgctctcgaaatcctgacctcagatgatcctcctgactcggcctcccaaagtcctgggattacaggcgtgaaccactgcgccaggccccattttgttttgttttgtttttgagacagaatcccattccatcacccaggctggagcacagtggtacacacatggcttactgcagcctcaaactcttgggcttgactgatcctcccacttcagcctcccaagtagctgggacttaacatgccatagttacagtgttatagcgttttgtgttttttatgtacttactattaccactgaattttataccttcaagtgatttcttattgctcattaacatccttttcttttagattgaactgctcccattagcatttcttgtaggacaggtttgggaccgatgaaatccatcagcttttgtttgtctggcaaagtctttatttctcttttgtgtttgaagaatatttttgccagttatactattctagggtaagctttttttccttcagcactttaaatatgtcatgccactctctcctggcctgtcaggtttccactgagaagtcagcggcctccattgcatgttatttgtttcttttctcttgctgcttttgggatcctttctttatccttaacctttgggatctaagtgtttggtcactgcagctgtatctgctttagggggcaccccaagccgagtaaccctgtggttcttgcaggtggcaaaggcagccaggccagtgtcgtcccctccagggtggcgagttccccccagtcctgggcggatacagagatgccatttgggagccagtgcctgtagttgggagtcttaggaatctagttggtgctgtattctactgtggctaagctggcacccaagctgcgagacacaggccttcccactcttgcctcccttttccacaggcagagaaccctcaccccacagccaccactgccccaggcccacggggagtactgccagactatcgctcgtgttcactcgaggaccaacggccctcagtcagcttgtggtgaatatgctgccatgcctgagcctctctcttcagggcagtgggatcccctctagccctagggcaggtcaggagcccaggcctggaactggaactggggaccccaggagcccacttggtgcactactccgctgtggtcgagctggtacccaagctgcgagacaaagtcccctttactcttccctcccttttcctcaaaccgaaggggtctctgcctgtggccaccgcagctgggagtgtgctgggcccgcacggctctgagtgtcagccgaggcctgcagcaagtacggcctgggtatggctgctggttcctcagtgcccaagagcccttcagtcagcaggtgatgagtcccgctagactgggtccttctcttcccttccggccgagggtgtctagaaatgtcgtctgggagctagggcctggaatgggggcctcacgactctgaccagtgccccatcttactgtggttgagctggtatccaagacacaagacaatgtcctccccacttttccgtgtcctctcctcaagcaagaggaaggaggggctcctggagctgtgagcggcactgcctggccttgggggaggggaggtgtaagcatggcccgagctaccccggctgctatctcactaagtcgcttgtaccccaagtccgctggctccgagcccagtccagcagcaggacttgcccgggacttgccgtccttgttgcctagactgcctttcaagtatatttcaggcccctgaatactttaggccgcagtggtgaggctttgctggagctcaggctccatccgctgaagatgggcgattcctctccggctagggctgatgtaaatcctcccttcgtgggcgcccgctaacttctgccccgtgttgctttctgctgggacacggcagcagcgctgagttccgacgcaaagccccacagtcaccgtgccctccctcccccaagtgtacagcttctctctctgcaccacgaggctgctgcggagcgggggctgggggtggggggtgccggggctgaggctggggcgcggggcggggagtgattcaagactgtccttcctacccttgtcacggcctctttcagtgatgtgaagttcaaccaggtcctgtgatcgctcacctgatttttggatattaggaaagtgcttttttgtgtggctagttgttcaatttggtgttcccgcagtggggatgatcactggaggcttctatttggccatgctgttctgcctctctctctatcttctgtgttgataaagccctttcaatattagtaagtgtatttaacacagtagagattcctgaagcttcttcatgactgttcaatttgggcctgatagcaatatgcgtttccttgtttcttatcctgtgactgagcaagcaggacattgtaacagtggaggaaaaatccccagttttccatgttctctcatccaaaaactttttgagagaaagagtacatttaggaagcaggacgaccatttagatttttactaatagcctggttttatatggttggttttatatggctatttataaatgttttgatttaacttgttaaagtgtaatatcccaaaattctatgatttatttttctcttttcccattgcaatatttatttatttatttatttattttgagacagagtctttctctgttgcccaggcttgggtgcactggtgcaatctcggctcactgcaacctccgcctcccgggttcaagcgattctcttgcctcagcctcctgagtagctgggactacaggtgcaccccaccatgcccggataatttttgtatctttggtagagacccagttttgccatgttggccaggctagtctcaaactcccaacctcagatgatccacctgcctcagcttcccaaagtgctggggttacaggcatgaggcaccacaccccgccccattccagtatttaaaaacgacttttgtgcacagaaaagagataacatgatgatttgttccccacaacttcaacttatttaatttaattaaaatttctaaacaggttaccatgtatataggaaggaaaacccacattgtatagagaccaaaatttatataatttagggttcctctttaagaatactaaatcacttgcaaatgtgtccattcatttagaaaaagataagaaatcacaacaaattacaaattttaaaaagctgacaaatacaacaaaaggcagcaaagtacaatgtttttgttcctattatattttgtactgaagctacctgtgttatcttttttccccacattttggctgcatagtgttagatcgcatcttcatctgacaatgatattgtgacataattctcactagagggaacagaaagataaagcagtcttccttccactctgcttgactgaaatgttttctgattgctatcacacagtctttgtttgtttccttatcagtaaagctgcaccagaaacttcctctgtcatttcctgctcagaggcgctccctgccccaggactagctctctgggtgtggcctgtggtccgtggtgtggcctgtggtgtggcccatcagtccgcccaggggtcactcgccctctgtgtggccagttgctgggttgctgttcctgcagcagctgccctaccctggccaggcccttactgtccctggttctctccatcccaggaccatcctaataaccgtttctccttttttctttttctttttttttttttggagacggagtctctctctgttgcccaggttggagtgcagtggcatgatctcagctcactgcaagctccgcctcccaggttcaagcgattgtcttgcctcagcctcctcagcctcccgagtagctgggattacaggtgctcaccaccacgcccggctaatgtttgtatttttagtagagaagcagtttcaccatgttggccgggctggtctcgaactcccgacctcaagtgatccgcgcaccttggcctcccaaagtgctgggataacaggcgtgagccaccgcgcccggcccatcctaataaccttgaagcctgattgtagcctcccctctcccacctgtcctcaaccatgcagggagtggagcagtgcctcacagggttcctcctcctggaagtcaaagaaaagtcaagcttttgatgaggtctggcagcccccgtgctaccactgaccagggtgtgagggtggcccaggcctctagtgcccagctggggtagctgcccagtccccaactgtgtggagagattctcaccgtggggaaactctaactttgagagtttgtcttaaaaggccagcacttttatagtatcagaggtttggccctacattttaaaatgtttttctctggtgagtctttgaagccaatcaatcagaatagtggttccatcagctgggagagcctcagcatcttcattcattcatttcctttgcaaatgggcaaaagtatcctttgggggaaactcctcccctttactctagttctagctgtacagaaaaaaagccaccatcacccagcaggatcgtctttttttttttaatttaaaaaaaaatttagggacaaggtcttgctccgtcacgcaggctggagtgtagtggcatgattatagctgactccagcctcaaactcctgggtttaagtgatcctcccacttcagcctcccaaagggttggggtttacaggcatgagccaccacgcccagccacccagcagaagaatctcatcaaaccctccagcatgctggagagtgtcaaggaggcctcccctgaggacatgagtccctcccctgtgactgtgcccggactgagggtctttgatggctacagagtttcacggtgtccctacagagttggtcagctcaggaacccccaggtaaggactggcaggcagaggggctgctccctactgtgcacagcactacagaaagtgtggatggaggatgagctgctattcagtgctgaagcttgaagctcacactggctcccacagcttcttctgccatcccatcaccttattccatgcaatccaatgtatgtattttcctgggatttctctagttattcagagcagaaggaccagcctcaaggagttcaagtagaggtcagtctcatgggggccagacagccgagctggccaccactcactcgcttccctcccagtacaagactcagacccgcatgaccatgattgagatgtctcgggtgccctcgagccaccccccccaggagccaaattcttcccaagagtccattatcccggggacagctgtcttgtgatcctgttccctggagaacacaggcacggaacaagccctgatccccttcggtgacgactcagtagtgtgcacagccaggaaaccacagaagacaggcagaaccagttctccagctgtagctacaagttaactataaaaagacccctgggtccacagggcagggctactcggctggctctggcccaggctcttgggcacaattctggccacagacgggaagcacagagaagataaccaatggtgtcacaaacaggttttccaagatttcaatctgggagacaggacacttcatccaggcttccggtttcaaaattggaagacaaatgtcctaaggggtcttgtcagttttgtatactggcacacagccatgatttacagaaacaggacttttggtctctcaccctggaagacaagaggaactaatcaaaatgggccaaaggaccagaaacttccagtggacatcacacttggacagatgagagcttagaaagcagctcaattgctgtgaccaaagttcggctcccccctcagtgacagtcctcctgggaaggaaggtaagagactcaaggagcctctggggtcctgctgggacttcccaggccagggctgtgctccagtggcagctatcctgaggccagggacattgaggggaacctctaaacaatggaaacagccaaagagatgatgagcgtaggtccaagtgcagccaggcagcctgaaaagagaaagggaaggtggagttctcagggacaggcttcagaggaagaggagggtttaaatgagtctcttcagtagggccaaagcaagttcatttcccaagggctaaaagtctgccatgtttttatgagttgtttgggttaaacctgggtcatgttgacctagatacatctccaagaaacaccagatatgggaatcttaataagaaagaatgagcaacatggttgtgatcttccaacagaaatacagtgcaagaggccgggtgcggtggctcacgcctgtaatcccagcactttgggaggccgaggcgggtggatcatgaggtcaggagttcaagaccagcttggccaacatggtgaaaccctgtctctactaaaaatacaaaaattagccgggcgtgatggtgggcgcctgtaatcctagctacttgggaggctgaggcagagaactgcttgaacccaggaggcggaggttgcagtgagccaagatcgcaccactgctctccagcctgggcgacagagcgagactccatctccccttcccccctccccctaaaaaagaaatacagtgcaagaaagtccagtttttttctcataacaatgttctgcttaagtttggagaaaatatgcattttcttaagcttgaaataaagtttggctacttttggatggggtctttgtgtcattcctacgtcagacaccaatctatactgttgccaggaggatggcgacatgattgatgggaaaaggaaaaacttcacacaggtgactccttagagcagggagcaaagcagtgacgcctgtcagaggcagaagcttccctggcaggactaatgacatttacagtcctcattgagagaaacaagagaaaaggcacatggaaactatactatgaatggaaaatggctataaccacagatgcagacaggattttaaagtaatggctattgtgaataactttgtgccaatacatttgaaaatacagttgaaatgaacaaagtcctagaaaaagaaattaccagtattgactcaagaaaaagcaaagaccctaaatagtcatataattataaattttttgttagtaataaaatatcttccgttcaaaccaaactctaggcctagatgacttcatcagcaagatctatcaaatattcaagaagcaatagttctaattttacacaaactctttcagagaattaagaaaaagaggctccactcttgttagaaggcaaacataaccttgaaaccaaaacctgtcaaggacattatgagaaagaaaattataagccaacttcacttgtaggcagagattcagaaatcccaaacagaatactagcaatatgtaaaaaagataatacatggtgactggactgggcacggtggctcacgcctgtaatcccagcactttgggaggctgaggcgggtggatcacctgaggtcaggagttcaagaccagcctggccaacatggcgaaatccagtctctactaaaaatacaaaaaattagctgggcctggtggcgtgcacctataatcccagctactcgggagggtcaggcaggagaatcgtttgaacccaggaggtggaggttgcagtgagccgagattgtgccactgcactccagcctgggagacagagcgagatgctgtctcaaaaaaaaccaaacaaaaggaaaaaaaaagataatacatggtgaccaagatgtgtttatctcaggagtgcaaagttagtttaataatataaaatcatttattgtaattaaccaaattaatgttaaagaagaaaaattacatgatcagcagggcatggtggctcatgtcagtaagcctagcactttgggaggctaaggcaggcagattgcttgaactcaggagtttgagaccagcctggttaacatggtgaaacctcatctctacaaataatagacacacacacacacacacacacacacacacacacacacacacaaattgccggtggtggcacatgcctgtcatcccagctacttggggagctgaggcaagaggatcgcttgagcccaggaggttgaggctgcagtgagctgagatcatgccactgcactccagcctgggtgataaagcgagaccctgtctcaaaaaaaattaaaaaaaataccaattacatgatcaccacaataagcacagaaaaagcactggataaaattcaatatccattcatgattacaaagaaaagtcaggagcctaggaattaaaatgaacttccttagcaaaggatttattaaaatagttatagcatcatcatatttaatgacaaaaagttgaaagcatcccctggagatcataaacaagaaaaggccagcgcagtggctcacgcctgtaatcccagcactttgggaggctgaggcgggtggatcagttgaggccaggtgttcgagaccagcctggccaacatggtgaaaccccgcctctactaaaaatacaaaagttagctggacgtggtggcacacgcctgtaatcccagctacttgggaggctgaggcaggagaatcacttgaacccgggggtggaggttgcagtgagccgagatctcgccactgcactccagcctaggtgacagattgagactgtctgaaaaaaaaaaaaaaagagaaagaaagagaaactgtaaaaaaaggaaaaggaaggaagctgtacctctacttcacaccattacaaaaatcaattttacacagattgaaaacctaaatatgaagggcaaaacgatgaatctttaagaataaaatgagaatagctccattactaggggtaagcaaatggttgcatgggtgttcaatttagaattgttctttaaactgcgcaatatatttgatgcactctatttcaaacagccttatcaaggtatagcctacataaaacaaagtgtgtgttgcttaaagtatacagaggctgggtgtggtggctcacacctgcaatctcagcactttgggaggctgaggcaggaggattgcttgaggccaggagtttgagaccagcctgggcaacaaacatagggaagcctagttgctacaaaaaatttaaaaactagccaggcattgtggcatgcacttgtggccccagcaacttggaaggccaaggcaggaggatcacttgagcccaggagttcaaggttacggtaaactatgattgccactgtactccagcctgggagacagagtgagacctatctctaaaataatgataataataaagtatataattttgctgggcaccgtggcatgcgcctgtaatcccagctactccggaggctaaggcaggaggattgcttgagcccaggagtttaagaccagcctgggcaacaaacatagggaagcctgggcaacatagtgagacccccatctctaattttaaaaaataaataacataaagtataccatttggtccattttgacacaggtatgcacccttaaaaccaccacaatcaaggtaatgaacatagctatcaaccctaagagcttcctcctgcatctctgtaaatcctccctcccaacactccccgtatcccaatctccgggcaaccccgatcagctttctgtcactatagattagtttgtatgttctagagttccatataatcatacagtatatcctctcaatgtggcctctttcagtgtaattattttgacatgcatttaggtagttgcctgcttgaatatcatattccttttggttgctgaatagtattcctttgcatggatgtaccacaatttatcattcaccctctgaaggacgtttgagttgtttccagtcagaactactacaaataaagctgctatgaatataaaaattcacagagaggttaattctgggtcgagaatgcagattgaacagtaaagctgtagtaaagcagctttggggagaaaaaaaggggcataactcgacatgaatgggaagggcaggggatgacacaacaggaacaaggtttggagagccggacaaacagctctccgaatgtcagagggcaagctgcagagagggagcccagggcccaggaactggagctgggggcggagggggcactaaaataaagaggactgggtgaaggttggccgcagtgactcacacctgtaatctcagcactttgggaagctgaggcaggtggatcacttgaccccaggagttccagaccagcttgggcaacatggcaaaaccccttctctatcaaaaatacacaaattagccaggcgtggtggcacatgcctgtaatcccagctactttggaggctgaggcacaataattgcttgaacccgggaggcggaggttgtaatgagctgagattacgccactgcacttcagcctgggagacagagcaagaccctgtcaaaaaaaaaaaaaggaaaagaaaagaaaagaaaaaggactgggtgaaagctggttactaatggttactaagcactctgagctccgggtgctagggtaacctattgtcccagccactttcagtgctgccagccccatgtcctctgaacgccctcagtcccaggcaaacctctctgcccgtgtgcccctgggcaactgtgcctcctccatcctgacagaaatgggggactttattctctggagagggcaaaggagtcagtgaactgtgggacaccaggtccaattgaaggcagtgaaattgtacccggagcagagcgacgctgtgagccggcactgcctgcaagcactgagcgacgtcccctcccctgctctgctcccagatctctgcaaccaggtcccggccctccaggcagcttgttacaagtgtcttctctagggaatctgatgtccccagagcttcttgtcgttctcccagactgaaaggcaggagctgccaaatggaaaaggcccacagtatgccctgcgtgtggctgacaacagagcctcccccaggcacatcaccatgacatctcagagcacggaggacatgaggaaggttcaacgagcttccaaggagagttcagtgtagaggcaggaagcagaatggccggcttatatttttgtaatgaaacggtcagtcaagtgagaaacagcacaggctcaggaaaaaagagtcgatcatcctcacaggtcctagacatgggagacacggcccggcacacgaggccccatggggaagcaccagggggtcgggaggcagaatacaggggcgacaggaagactgaggccagagcctttactggggtttccacagcaaaggcaaggccagcagtttaaagagcttaagggcacagggcttgtccctggttgcctggcgcctggctctgggatgatgaaggcagagggaggacgaaagggcctgggctgctcagtctgcacaccaaaggcctgttagcagcagggcccttccttctctctaagaattggctggccctgggaggacagtctctccagccagaaagagtttttttgttttcgtttttggagtttttagaaaagatgtctaaacattataatatacaggtaatgtatgtgcacacacacacacacacacacacacacacacacacacagacgcaaacacacacacacaatacacacactgcaatggcaacacctggagctaatggagcaattccctccaaatgctggaggaaaatcatttccaacctagaattccacatgtagccacatcatcaacggcatcagtggacagaaggttgtcagacatgcacgttctcaaacatttctctcccacacactctttctcagtgcgccaaactcagggggtagacaagaacaagacgacaagggctacagggacaccagtgccaacagacaggagacacaaaggagaccccgggaggagggttcagcctgaccagctcccaggcttgagggcagccagcctggaacggcaaagtgtgacttagagacagaggtgtgcagtctctggttcccatcccagccctgtcaggtgcacgactgcagacccctgtttcccaggagtcgctaacaaccttgcccactggctttcccagaaatgaactgtcagggaagccgaggccaggccgtgacccagaaactccgtccagcttccttctcctgggagccttggcctagagaaagggcaagcggttgccctttccttactcaccacttggttttctatgcatcacctttcttgtgcatttctacaaagcgagacttccctgtcactccatctaaactcacaaccctcccactgcctgtcatgctagactctggggctagaacactgaagaaatccgcaaagatgccatttcctccttgacaccgataacaaaggcaagagaggtgcaagtgtgtttgcggaagttattcattcagtgaactgacatgtgagtgccgaggatgggccaggcacttccagatgctggcttgagccctgttcttggggcacgctcctttgagcggagaagaccaaagtgaacacctctagaatctggaacgttcagtagcgataggtgcttggaaggaaggcagagctaaggcggagagcaggaccaggtagcagtggcagtggcagctgctgttccatatgtgctggatggagagggtttctcagtggccaaggccatttgagtaattgattctgatttcctttgcagcatgatatattatcctcctttgtaaatttgtccttggaactagatagcgcacattctctgtagtgtacacagtttgacacatagttttagccagcttgtttccttctcttggttttgccccaagaaaaagactgtgtcatacttctgcccatttcttcttcacctacttccagcaaattgtgctttctctaataaatgctgcccggttcataaagattcattacagttacctctttatggcaaagtggtctccttattgacataaaattatacttttttgataccatttaatgttctttgagttctgctttgccagacaccattactacttttttcattaatttacatttattcacccaaactgaaagaggttgctgagagcagatgggtctctgaagagttcagacagttgttcaattaactggcacttctgagggacaaaccagtgacccttttcttggaatggcagggccatagggcataagtcagtagctggttcacaggaaatcatccccattttcgaaataagtgattatctggaaggaaacattctggaaccaagtctagcaaactcagatgcgaggagcaacagcggtctgaacagtggcggtgagcaggaaagccacgtagatggagaactgtgagaaagccaaaatgtctaaagctgtggggtaacaacaagtgaaaagctgaacaaaccgaaaaatcaacagcttttcttagacctataagaaaagctcacttccactgccctggaagttggagagacagacaggtggatacagagaatcacgactgggcagaaacatccgtgggaaccactgctggaggggagacctgaactgtaattgacgaattgctggaggctaggtatggacaaatttcagagcgaaaaacttcaggggtggccactgatggggtgagcacacttttgtgagttttacctccaggagcttgaccaggttctcacagtaaatatcagagaataacttcctcatgcttctggcagggggagggaaaaggaaccattttgaaatcattacctccaacttctcagaaaccctggaagcaaggaaggagcagagtgaaatgttttcagtgttgagagagactctgcaccgacctagaattctgtactcccggaagttatccttcaagagtgatggagaataaagactttctcagacaaataaatattgagaaaatgtgttgccagtagacctgcattgcaggaaatggtaaaagaagtcctttaaagagaaggacaatgacatagggtagaaacttggatatatgtaaggaaaggagagcatcagagagggaataaatgaaagtaaaagaaaaacgtttattttccttattcctgattgatctaacagctaacattttcttcaaaataataatagcaacaatctatttgattatgtagcctaatatacaggtgaaatgaatgacagcaatggcgcagggatgagagggaagcattaagattattgtgttattataaggtactcacactacctgggaagtggtacagtgttatttggaagtgggcttggattagttgtaaatgtatatggcaaactctagggcatctgctaaaaaaggtattaaaaaagaagtatagctgatatgctgagaaaggagagaaaatagaatcatatgaaatgctcaattaaaaccacaaaaggaagaaaaggagcagaaaacaaaaatagaaacaaaagcaaaaattagaaaacagcaccaaatatcattaaatgtcaatagtttaagtacaccaattaaaagacagagattggctgggcatggtggctcaggcctgtaatcccagcactttgggaggccaaggtgggtgcatcacctgaggtcaggagttcaagagcagcctggccaacatggggaaaccccgtctctactaaaaatacaaaaattagccaggcatggtggcaggcacctgtaatcccagctacttgggacactgaggcaggagaatcacttgaacacgggaggcagaggttgcagtgagtgaagattgcgccattgcactccagcctgggtgacagagtgagactccgtctcaaaaaataaataaataaataaataaaataataaaagacagagattgtcagaggaagtcacaaaacatgacccaattatatgttgtctacaggaaacccatttgacatgtagacacctgtagattaaaggtaagtggatggagaaagatatatcatgctaacagataatcaaaagaaagcaagcagcagctatattaatttcagacagagcagacttcaaagcaaggaaagttatcatggataaaaaagggcattacaggctgggagcggtggttcacgcctgtaatcccaaccctttgggaggccgaggagggtggatcacctgaggtcgggagtttgagaccagcctgaccaatatggagaaaccccgtctctactaaaaatacaaaaaattagccgagcgtggtggtgggtgactgtagtcccagctactcaggaggctgaggcaggagaattgcttgaacccgggaggtggaggttgcagtgagccgagatcgtgccattgcactccaccctgggcaacatctcaaaaaaaaaaaaaaaaaaaaaaggcattacataacaataaaggggtcaattctccaagaatacacaacaatcctcaatatgtaagtgcctaacaacaaagtgttcaaatacatgaggcaaaaactggtagaacgacaaggagaaattgatgagtccattgacaaagttagagacttcaatacccctctgtcagaaattaacagatccagcaggcagaaaatcaggaaggacatagttgaactcaccaacaccatcaatcaacctaatataattgacatctatagaatactttatccaacagcagcagagtacatgttcttctcaagctcccgtgggacattcaccgagatggaccacattctgggccataaagcacaccttaacaaatgtaaaagaataaaatcacacagtgttttctctcagaccacattggaattaaacaagaaatgaataacagaaagataactggaagtccccaaatacttgaagattaaacaacatgtgtctgaataacacatgggtaaaagaagaaatctcaagagaaatttataagtattttgaactaaatgaaaatgaaaacacagcttactaaaatgtgtgggatgctgtgaatgcagtgcttagagggaaatttatagcattgactgcatatattagaaaagaagaaagatctaaaatgaataatctaagcttccaccttaggaaactagaaaaagaagagcaaattaaattcaaagtaagcagaagaaaaggaataataaaaattatggcaggccaggcactgtggctcatgcctgtaatctcagtgctttgggaggctgaggcagaaggattgcttgagctcaggagtttgagaccagcctgggcaacatagtgagaccctatctctacagaaaataaaaataaaataaaatttaaagtaaaaattatagcagaaatcaataaaattaaaaacagtaaattaatagagaaaatcaatgaaatcaaaagctggttctttgaaaagaataatacaatttgtatggctctcgctaactaggaaaaaaatagagaacacaaattattagtatcagaaatgaaagagagaacatcactgtggatcccatggacattaacaggataataaagaaatcctatgaacaactctatgcccacaaatttggaatctacataaaatgaatccattccttgaaagacacaatctgccaaaactcacacaagaagaaataaacaatctgaataggcctatatctttttttttttttttttttttttttttgagacagagtcccactctgttggccagactggagtgcagtggtgcaatctcctctcacggcagcctctgattcccaggttcaagtgattctcttgcctcagcctcctgagtagctggaattgaagatgcccaccaccacagctggctaattttttttgtatttttagtagagatggggtttcgccatgttggccaggctggtcttgaactcctgacctcagatgatctgcccactttggcctcccaaagtgctgggatgacaggcatgagccactgcgcccagcctgaataggcctatacctattaaagaaattgaatcaataattaataaccttccaaaaaagaaagcaccaggcccagatgggttcattgttgaattctaccaaacatttaaggaagaaattacagtcatgtggcacatcagagccttccactcaatgacagaccacatatatgatggggattacaatgcttaggatatgtttagatacacaaatacttaccattgtgtcacaattgccaacaaaattagtacatgaacatgctgtacaggtttgtagactgggagcaataagctaatccatataggctacaatttaagtttgtataagtacactctgtgatgttcacacaataatgaaattgcctaatgatgcatttcctggaacatatccccatcattaagtgatgcataactgtataccagctctttatgatctctttcagaagaagctgagagaatacttcctaatgcattctatgaggctagcatcaccttgatgtcaaaaccagaagacataccaagaaaactatagaccaatatccctaatgaacatagatgcaaaaatcttcaacaaaggattaacaaatagaattcaacaatgtatacagagaattatgactatgaccaagtaggatttatcccaagtaggcaaggctggctcaacattcaaaaatcaattaaagaggccgggcgcggtggctcacgcctgtcatcccagcactttgggaggccaaggcgggtggatcacctgaggtcaggagtttgagaccagcctgaccaacctggtgaacctctactaaaaatacaaaaattagctggctgtggtggtgggtgcctgtaatcccaactactcgggaggccaaggcaggagaattgcggaggttgcagtgagccgagatcacgccattgcactccagcctgggcaataagagcgaaactctgtctcaaaaaaaaaaaaaaaaaagaaaagaaaaaagaaagaaagaaaaatttgtccaagcgtagtggtgtgctcctataatcccacctactcgggaggctgaggcagaagaatcgcttgaaccttggaggcagaggttgcagtgagacgagactgcgccattgcactccaatctgggcgacagagtgagactctgtctcaaatcaaacaaacaaacaaaaaacaaacaaacaagaaaattgggtcgaaaatctttagagaaacctccccaaagaagatagacagatggcaaataagcatatcagacgatgctccatatcatacattatcagggaaatgcaaattaaagcaacaatgagacgccagtacacacctactagaatggccaaaatccagaacactgataacaccaaatgctggtgaggatgtggagcaatggaaactcattccttgctggtgggagagcaaaatggtatagccaccctaaaagacagtttggtggtttcttataaaactaaacatacacttgccagatgatccagcaatcacactccttggtatttacccaaaggagttgataagttatgtccacacaaaaacctgcacatggatgtttatagcagctttattcataattgctcaaacttgggagtaatcaagatgcctttcagtaggtgaatggataaataaacggtggtatatccagttgatggaatatcattcagtgctaaaaagaaatgagctctcaagccatgaaaaaacattgaaagaagcttaaatgcatattacaaagtgaaagaaggcaatctgaagaggctacagactgtaggatttcaactctatgacattctggaaaagataaaactatggaaacagggagaatatgggaattctctgtaccttcctctcaattttgctgtgaacctaatagtgctctaaaatataaagtctttaaaaagaaatctggccttccctctccctcaccctgcaggggcaggtcctgttgcctgcctgtcccaggatccaggctcagctggtttctggctgggtttgaccataggagacccgagccggagactagagggaagaagaagtggggggagcagctcggcggcagctgcagctcctaccaaaaggcccctgtggttctaggccttctctctgtggccccccaacctcgggtgggctgtgctgatcccctatcaacctccaagtagtcctgggtaccctttccctggtatttagtgccctaagtcgaagtggtttctgttttcctggggcgactctaaactgatgaaatagtcacttggagactgatatgatttggatatgtgtccccacccaaatctcatgttgaattgtaatccccactgttggaggtggggccaagtgggaggtgattggttcacgggggtgggtttctcatgaatgatttagcaccatcctcttggtgctatccccacaatagtgagtgaattctcaccagatctggttgtttaagagtgtgtggcaccctggagccccagctactcaggaggctgaggcaggagaatcacttgaacccgggaggcataggttgcagtgagccgagatagcaccatccactgcactccagcctgggcaacagagtgaaactccgtctcaaaaagaaaaaaaaaaaaaagtaaccccgacaatgtaaaattaaagtgtagctgatgcaaaatggtcaaagataactttactagtgaaagctaatggaacaagagatttaaatgtattatttaaacatacaaagaactaaagataacagtggatggtgttacatacatggtcatatatcaggtgtgggggtccccaataccacctgcaggaacacccaggcctgctggagttaactcttgctacacagaaagaggagagaaatgtgtcccatccagcaacaaaaacctatccttccatgttttgtgtataggttgacgctaaaacctgaaaagcaaaaacaaaaattcacattagaaagtctatgtaaatattttcagtgccaggtcaagaagaggaatgctaggattatatttctttcttatacgtctaattcgatagtccctgagtcatttgaaaagagaactttcctagcacccaggtcccaatgattctcttcttaccatgaattaggaaaattatgatctattttactttacttctggcttttttcttttttctttattttatttttattttttgaaatggagcctcgctctatcacccaggctggagtgcagtggtgcaatctcggctcactgcaacctccacctcccaggttcaagcaattcttgtgcctcagcctcttgagtagctgggatcacaggtgtgcaccaccacacccagctaatttttatatttttagtagggacatgttggtttcgccatgttggccaggctggtcttgaactcctggcctcaagtgatctgcccacctcggacccccaaagtgctgggattacagacttgagccactgtgcccggcctgcttcttgttttgatcataactttctttttttttttttttttttttgagatggagtctcactctgtcgcccaggctggagtgcagtggcgctatctcggctcactgcaacctccgcctcccgggttcacgccattctcctgcctcagcccccgagtagctgggactacaggcacccgccaccacgcccggctaaatgtttgtattttttagtagagatgggatttcactgcattagccaggatggtctcgatctcctgaactcgtgatccgcccgccttggcctcccaaagtactgggattacaggcgtgagccacggctccttgcggatcataactttcttgtatagttctttccttctggtatttttaattgcttttccttattttcttgtactatttgccatcatcgtatccaacttcagactcccaatcacaccatctaatatgttgaattcacatatacacaattttttttttttttttttttgagacggagtctcactctgtcgcccaggctggagtgcagtggcgcaagctcggctcaccgcaacctctgcctcccaggttcaagcgattctcctgcctcagcctcctgagtagctgggattacaggcacccgccaccatgcccggctaatttttgtattcttagtagagacggggtttcgccacgttggccaggctggtctcgagctcctgacttcaggtgatccacccgcctcagtctcccaaagtgctgggattacaggcgtgagccaccacacccggctatacatatatatttaattcttggagtcctctctcccagagcctaccattctcctactccaacctggactgattgccaaccaggctttctgcccagttggcatccctggtatttcccatcacagctctcctggattagatccattgtcttatggatcccacattttcctttttcttggcttgcacccttgatttgctgcagagcatccccaagtagcttcctaagaaagtacatttcagaggcaaattttcttagctcttgtgtatctaaaaacatttttattccattatcacacataatggatattttggatggtgtacttctatgtggaaaatcattttcccttggaatttggaaagcattgccctattatctttttcttttcttgttgtcctgtgatcttttatcattcagtgttgttatgaactctggtgctactctgattcctgttcctttttctttatttcatttttccataattcttgttagttgcttgccagacttcctagatcactcctcaaagtcctcatattttctctcatatctttgtctctattgttttgttctattttctgggagacttcttcagttttattttccaatatttctattgaaatttgaatttcaataattccttcttgttctctgattgctctttttacataatattctgttcttgttttatgaatacagcattttcttttagttctgtagatatgttaattaaattaaattttttgatacattccctgaattttcttgaattccaagtttatattttttctacaggtttatcttgactctttttcctgttgaaggctttcatcaaatttctgataatatttactgactggtttatatttaataaggaaggactggataagtattgtggatttaatctgctgttgggcaaataggtctgttttcctgctgtgactcttctctgtgtaggacagggaggtgacgaacagagtatcccctagatgccggaatgaggaaacaattgttcaggggttgtcagcatccatgctggaagccttagctctccaccgacatttcaatcaatttctttacagaactgtcaggtgttttccctgtaggtctgtgccagctcccagctcagctgtctggtggggagaggaggttccaactggtacagtcattctgtactggtgccttcaattaatccccatgtgttcagtcctatttaattctatcgttttctaccacatgcctactgattctgattgtctggtgttatatctagcaaactcactcccacttcttctgtggctcccttgtcaaatattctcacctggatttttactgcctattttattcatcaatcaattcccatatgctttctataaagttgttgtcctttgatgataacctctcatcctcaccacattctcttcactctggtgggtttattcctttccttttttttttttttttcagacggagtcttgctctgtcacccaggctggagtgcaatggcacgatctcggctcactgcaacctctgcctcctgggttcaagcgattctcctgcctcggcctcccaagtagctgggattacaggtgcgtgccaccaggcctggctaattgtttgtatttttagcagaggcagggtttcaccatgttggccaagctggtctcgaactcctgacctcaagcaattcaccctccttggcttcccaaagtgctgggattacaggcatgagccaccacaccctgcctcctttctgtttcttgacattcttcttttagtgcacttctatgagtaaagaaggaaaactgtgtgtgtgtgtgtgtgtctgtgtctgtgtgtctgtgtgtgtgtctgtgtgtatgtgtgtctgtgtgtctgtgtatgtgactgtgtgtgtgtgtctgtgtgtctgggtgtgtgtgtgttcatgcacatctgtgcctgctcatggtgtcttatatcagaatttattcatttcttatctattttctaacaaatatggttaaggctattaatttttctaggtgacctctgtagccttatctcctaggttttaatatgtagggctctcaatgttggtcatttcttttgtttttagagacaggggcttgctctttctcccaggctggagtgcagtggcatgatcccacctcagcctgttgagtagctaggactacaggtgcgcacgtgcccagctaatttatttcatttttgggaaaaacggggtctcactttgttgcccaggctgatctcgaactcctgggctcaagcgatcctcctgccttggcctcccaaagtgctgggattacaggcatgagccagcgcccctggcctggattagctcttctgaaatatatatattctctatcagtttaagagatttttagacaaatggagtaaaagtttgtgttgtttgtcatattgataaaatccttctggttgtgggctttctgtcaattaccatctatactagattttcctggtttttatcttctacagtcctgtttttaagaggaccttaaactattacagtcccattttttaaattactgatttttaattctaatagtaaataattttgattatagtatatttttcttttttttcttttttttgagatggagtcttgctctgttacccgggctggagtgcagtggcacgatctcggctcactgcaagctccgcctcctgggttcaccccattctcctgcctcatcctcccaagtagctgggactacaggcgcccaccaccacacccggctaattttttgtatttttagtagagacggggtttcaccttgttagccagaatggtctcgatctcctgacctcgtgatctgcccgcctcggcctctcaaagtgctgggattacagacgtgagccaccatgcccagccgattatagtatatttttctacttttcaatggcaagtgtgaaactgtataacttaagttccttctattcaacctaaggaatttagcaagattctcttcattattttttaatatttcaaaaacttcttgagttctagtcttgtacattattctttccaatctagatttaagttgttatagcccatgaaacttcttgacttttgattgagcaaagaatttccagagttattgatgaagaattaacatttctataatgttaatgcttcccctccaggaatacggtagcgtctgtttttgtttttgttttcttcaggtcttcttttagatttttcagtaaagttttatagctttttgatgcaggttttgacatttcttattaagtttattcccagctgttttataatttttgtagtgagagtgagttgaatcttttttccctcattacattttccagctttttattactggtcgtgtttacatgcctgcatcctaacaccggggaactgacttgaaatgggcctttctccccgcagagacgcaccaagaatgaggtttaaaagagaatggaagaaggatgtatgtggggctttttatttttgttttttaattgacacatatttagggagtacaatttgatatttcaatatatatttatgttgcacaatggtccaagcagggtagttaatatatccatcagctcatgcatgtaccatttctttgttgtgggaactttcaaaagtctctcttctaggtattttgtaacatacaatatattgctgtcaaccatagtcaccctgctgtgcaatagaacaacataatttttttttttgagacagaatctcgctgtgtcacccaggctggagtgcagtggtgtgatctcagctcaccaggttgctctgcctcctgggttcgagcgattctcctgcctcagcctcccaagcagctgggactataggcacccgccgccatgcccagctaatttttgtatttttagtagaaatggggtttcaccatgttggccaggctgcactcaagctcctgacctcaagtgagtcacccacctcagtctcccaaagtgctgggattacaagcgtgagccactgcacctggtcaaaacaccagaatttattcatcttatctaataataactttgtacctgttgaccaacctctgcccatcctcctctccccgatcctctccccagtctctggtaactactgttctactctctgcttctatgatatcaactcttttttgtttttgagattccacatatgactgagatcatgtggtatttgtctttctgtttctggtttatttcccttaactttatgtcctccaggttcattcatgttgtcttaagtgacaggatttcattcttttttatggccgaatattattccattgcatatatgtaccacattttctttatccattcacctgttggtggacacctaagttgattctgtatctggctattgtgaatagtcattcaataaaaatgggagtgcagataactcttccacatactgatttcatttcctttggatatataccggtagtaggattgctggtagttctattttcaatttattgagaaacctccatactgttctccatagttgactatactaacttactaccccaccaacagtatgaaagtattcccttttctccacatctttgccaacttgtcttcttttgtctttttgattaaagccattctaactgaattgaaggggtatctcattgggcttttgatttgaatttccctgatgatgagtgatgttgaactttttttcccctccctccctccctcccttccttctctttcttttttcgagacagggtctcactctgtcacccaggccaaagtgcaatggcacgatcctggctcattgcagcctcaaactcctgggctcaagtgatcctcccaccccagcctcccaagaagctgagatgacaagtgtgcacaaccatgcctggctaattttttgtttttttagagacagtggtcttgccatgttaaccaggctggccttgaactcctggactcaagtgatcttcccacctcggcctaccaaagtgctgggattacaggtgtgagccaaggtgcctggcgagatttttcccatatacctgttggtcatttaaatgttttcttttgagaaatgtctattcaggttttttgccctctcctaaccttttattttatctatctatctatctgtctgtctgtctgtctgtctatctatctatctatctgtctatccatccatccatccatccatccatccatctatttcgagatggagtctcgctctgtcacccaggctgtagtgcaatggcacgatctcggcttactgcaacctccacctcccaggttcaagcgattctcctgcctcagcctccagagtagctgggactacaggtgcgtgccaccacgcccggctaatttttttttgtatttttagtagagatggggtttcaccattttagccaggatcatctcaatcccctgatctcgtgatccgcctgcctcggcctcccaaagtgctgagattacaggcgtgagccgtcgtgcctggtcacctttttttttttttttttttttttaaagacagggtcttgctttgttgcccaggctagagtgcaatgtgcaatcatagctcactgcagcctcaaactcctgggctcaagtgatccttccacctcagctttccagggagctgggactacaggtgtgtgccaccacgtctgtctaatttttaaattttttttgtaaagacggggtcttgcttcttgctatgttgcccaggcttgtcttgaactccagttctctgatttttaaaaaaaatcataagtagatgttgaattttatcaaatgctttttctgcatctattgaaataattatgtagtgtttttccccttaagtttgttaaggttgggtttctaattttaaaccatatttgcattcttaggataaaactcaactcggttgtgatagatcatatactgcaggattcagtttatttgtctagaattttaaaacttatttccacatcttgtgtcatacttttcttggctcatcatagtagatatattagtctagtaaaataagtttggagacatttatttcttttctgtgtatgattggaattgcctactcattaaagatttggtagaagtcatccataaagccctcttggtctgtttctctctctctctctctctctctctctctgtgtgcgtgtgtgtctgtgtgtgtctgcgtgtctgtgtctgtgtgtaggaggatgggtagctttttaaatacatagtcaatttcattgtggttacagggattttctgtttctaaagtcggttttggtaagctgtactttcctaggaatgtattccttttgcttatgttttcaaatttactgacacacagtgcataataaaaccttttcatgagtaacataatttacttttctcttttctctttatatccagcttgttagagggttggcttttgtttttcagcttttcaaagaagcaggtttaaaattttctcaatcctctccatcatttgtttctatttcattaagttttattcatccttatttttctttcttctacttttgcaggcttactctgtcatttctttatggcttcttgaattggatgttcagcgtgatgacttttggactgctttagccgcatctctatacttcagcatcgcacacccaatggcttactcaacatctccactttcacaccactgggcaccccaagcttaatacagccaaagcagaactcttgatctgcacctctgaaaatgtacttttcctgtagttctccccactatggtgaaaagcacccttatttccccagttgctcaggccccaatctcaggaatcatccttgtttcttcccttgctctatgccctacatccaatccttttgttcagttctgaaaacatatcttgaatctcacaacttctcagagctgcactgctgccaccctagttaaagctaccatcaactctttctcctagactgttccagggccttgcaactagccttgtgctgtagttttgtttcatcacgtccagttctccactctacacctgcaacatagatcagacagctcctggctcaaaatcctctgagggcttctcatcttagaataaactctcggttctggccgggtgcggtggcttacgcctgtagtcccagcactttgggagtccgaggcgggcggatcacttgaactcaggagtttgagaccagcctgggcaacatggtgaactcccatctctatcaaaaatacaaaaacttagccaggcgtggtggttcgcatctgtggtcccagctacttaggacgctgaggagggaggatcgcttgagctcagggtggacgttgcagtgagccaagattgcgccactgcactgcagcctgggtgacagaatgagaccccatccccaccccccccaaaaaagaatgaactcccagttctcatagtggccccagctgcctttccaatcacattccctaccactctccagcaacactgacttcctcgttagtccccaacatgccaggcatagtctctcctcatgtcctttgaacttgcctggaatgttctttccccagatattcatatgagggagtaaaatgagggtgaaaaccagcagatatctaaatagcacccccttcacttagtttatctttctcaaagcccttatcactatgtgaaatgatatattatacttatttgtatgctagtatgaatcttcccggcaagaatgttagtttgctgtctgttcagtaccgtgcatccagagcctggaagagtgcctggcacatagcaggtagtcaataaatgaatgggggcaagcagccaaatcagaatcaggttttcttgctaagcatagaactaacagaaggatcattgaatggattggataatgactggcatcagggtaaggtccccttaacaaacactcctgtcctgaacacctggttagctaacagttttctcatactcttattttcccaaaacacaattgctggatctcagctccaaatcaactcttctaggaaagtgaaaaattgctggatctcagctcccaaatcatatcttccaggcagagctaacattgccccttattcacacctccaccaaaccatctgatccaacagtgacaggtgtcacgaggccttggcatgcactctcttcccccgccagagttctgcgaaagccagggttgcgatttgttgtcagtttattccccgcctctatgagagtgtgagcactgggcaggctcggatgaaataatgcattgagtaggcctctgaaaccaaggcccctcagctggggcaacgtcaggctccagggtgggcaactttgctgcttctgccgaagatagtgatattgagaaaatgtgggtgcaatgaaacgcttattgcagcgcactcggtgcatctgtggacagagggtcaatcgcccctcagagcagcgcaaacaggcgtcccaagcctaggccttcacttgccccagcatccgcaagggtccattaatccttaacattcaaattccgcccactaaaccagtccctccgcgcccaagccgcctcttttccccaaacgacggccgaaagcagccaatcaacagctggaggggtccgcccccttttccctggccgaaatggacaggaaatctcgccaattgacggcatcgccgctgagacctcccccctcccccgtcctccccgtcccagcccggccatcacagccaatgacgggcgggctcgcagcggcgccgagggcggggcgcgggcgcgcaggtgcagcagcgcgcgggccggccaagagggcggggcgcgacgtcggccgtgcggggtcccggcgtcggcggcgcgcgcgctccctcctctcggagagagggctgtggtaaaagccgtccggaaaatggccgccgccgccgccgccgcgccgagcggaggaggaggaggaggcgaggaggagagactgtgagtgggaccgccgtggccgcgggcggggacccttgccggggggcgggggtcaggggcgggacgtggcgcgggaggggcccgcggggtcggacgacacggctggcggatggcgtccctcctctctaccctccccctcccgccgccgccggtggcgactctcccctcggcccgtcacccgtgctcgcgggtgaccgtcctcggcgcggcctccctggagccgccttcgcctgacgcccctcttcctcccgccctcgacgcgcatcccggcccccggccccgcgggcgcccctgtcgccggggttcgcctgtcggggctgcgcgcgctcctgcccttctcggggctttgggccgcggcgccgtcgcgcgcccgcggccccggcctctccctggatcgcgctctccccctccctccctcgcgcgccccctctcccgttactcggcccccccaccggcgcgcgtgcgcacttcgcctcccgtcgggagagtgcgccacaagggctcctgagctctcacccccatctctgggctttgcctccccctccttctcgcccattccatgaatttctgccccccgctacccccccgcgagcgagtaggtccaccggctcctttccccatctagcaggaacaagtaggtggggattattatccacaaaagggactagacattgtgttctgggtcccacaactcatcataaagaggtggttatagttcccatcaggagccgtgggtaggggactgtgcgtccagcagcacccgaggctcttcggcgccagaggctctaaggtgcgagcgtgtccccagggtgctcagaggttctttggagtgctgtggcctcggaatgtgagcaccctcccatcctaccctccccttcgccggcgatcttccagttacataagtggagtgggacatagtaggtaacgggctctcatcgccctggagcgctcgggatcaccggtaccagatggggcaagttcatcgcgacgctgtggctcctgttaattgtgcctgaaaggttatcctctgttcagtttggtcatgaccgaatcacccaaactgaaactcagatgacttttatatggcagtggcaatgtttctgtggttttgcactaaagacttaaggtcattatgaagagtgtaaaaggattgctgtcgcaggggagaccgtttatgacattgctaagtatggaccccgagggggaaaaagctcattctggaattgctctgtggcggttgcttctgttgcgagtgtgttcgggtgtgggttggtcacagcagaaatgggctccaccacaaaattgatattcctgactcatggtcaggcagatgtgtgcttctggttatttttccaggaacaggaatgggctctgccgagcctttcacacgttgtgtctctgctgtgcgggatcagtaccccagactgtgagataacaggatcgaattcaggggttggttggtgatccaggaaccatacctacttggatgtgatactgagtggcctagacgttgtaggactctcataagttttagacattttgttatactgtaaaaatgaagcatatacggcctcagtagtaacattgcactaataggtaattattactctagagaattttgggttccatggctggaatgttcatcagtatctcagcaatttcagttaataaccagattaagctgacctcttgagtcttttgaaatctgctgggtccctataataagacagggtctggattttttaatcttttgggaatttccaccaaggatttagggaaataggcttttatgggcttttcaggatttctatttcaaatcccaatgaggaagtctaggaaacacttgcttttattttcttgcctgaatatgtcagaaccttaaatcacccaatcaatctagaagtactacagttgattaaagtaagtcaccacaggtcacccattcgtggcaggtcagctaggtggctgatcactggaatacagtcatatccccaggcatacacacgagcctcacttgacgatcccaaagtttgtacatctgagcttgagacgtgacaagttgaggtctctgctttgttcttcatagttggcagtttgtctcctcgggtgcccctccggttagctgtttatcatacgtctagccctatcaacagtgcaggcagcttccagagtatagttttctctgcaaagtgcctggtggaggggtacctccttttccattgtcctaatggctccactgggcttccataccagccctttccagtgtcttaacagctcaaagaaacccatctgtggctttcttgttagcactggcctatcacaccttcctattgcctgttaactaaaattttgcctggaatgctttaagcttagagtactgggtctttgtttcacccgattgataggagagtgtcatgcagtcagccgaactccgacttctgtgctgtttaaatccttaggtaggtctggggcaaggcacaaaccactgtgtattcaaagggttatggtgcttgcattctgtgtgtatatgtttgtaatttccaaccagagtcgtttcccgtgcctgccctgcctctgtgcaatctagtctagtagggtagggaggcaagctgtggagtttgaaaaaaaaaaaaaaagctagatgagtttaataggctgttaccccctccagaacattcctcccatgtggagatgaaacgagaagttcatttctttaacctaaaataaagaacaacagagataaaattgttagttccttattggagcctggtttccattgctaatgtacctgcttgggactctgcatgataaatgacgtgtcctggaacctgaaatcttttataaaggttaatatcagcagaaatcttttaattagctaagagcagcttgttctcaagctgcccgagttatcttggaggagagaatcacaggaaatgtttgatatttctagtaaccagtgttttcagtgcgtggggtaaagcacactcctagactggccagtcccaaagagtgtggcaggacacctgcttgttttccctgccctctgctatggtgacatccttgcagaccagtcttgcgtggctggcagacgcaatctttttttcttgggtagagcattatcaccgctgcgatggaaggaccttgtcctcggtgcctccataccagccctttccagtgaaactactgctgtcccggcaagcccctgtgcgtgtgcatcattccgggtaggacaagatgtgaacaggtccctcttctttgggcttaagtagaagttgtgctcttctgcttttacctgtgtgctcttctgcttttacctgttctcttctgcctttctcttgcaagaaacctgtcgaaagcttgctttgcatgccattgcttaaatactttgatggtatgtatggtatgtgggataactgagtgggagccggaattggggggtgggcagggcatccccacccccacccccacatcaaagggggaatgaccatttcgttagagaataaagcctgagtcttataacttcttcaagcacatgtatgctgggtctcctggcgtgtgaatgtgttcccgctgtgctgtgtggctgttttgcagttactgtagacactgtagtctgggctctcattattgcctctgaagttgacaggaccaagccttagtaaggatgcacttgtcttcctagcccaagagctaggggtgttttatatatatattaactttcttttttagatttcataaactgctctcattttctcttttctttctttctttttttttttttttttttgagacagtctcactctgtcacccatgctggagtgcagtggcacgatctcagctcactgcaacctctgcctcccgggctcaagcagttctctgcctcagcctcccaagtagctgggattacaggcacctgccaccacgcctggctaatttttgtattttttttttttttttttttttttttttagtcgagacggggtttcaccatcttggccacgctggtcttgaactcctgacctcgtgatccacccgcttcagcctcccaaagtgcagggattacaggcgtgagccaccgcacccagcctctggctcttttctttttgacatgaaatcttaagttaattatcttaaactttaagaactagaaggattcttagtccagcaccatcagtttacaaacaaaaaaaacttgtgtccctgagaagttgtgacttttccagggcctcctagccaggataccagtttggtttttattatatagctagccgagtaatactattaacttgacttctgggatttcaaagtattctatgacttgactgtttaagggaattatgaggcctcactgaacctcaaaagataattttaggtaccatcctggtagctgtagagcagcaacagaccagtaaaagacttggttggtgttgcccttcttctgggtttgattacatgagtaattgtgtgaatagtctctaagttgtatgctctgagctttcgtttttagcttataaaagtgctactcttgggccagcatagtatcagaaattagctaattcatatggggcagtttaggctttaactaggaaatgatggttatcttaatgacaaaaaaggtactgacaaaagtccttttttgaacatgtgttcaaaagaaaaagagaaactatcaaactaataactgagtttgttgaacatcgagattgactgatctgagaggcttaaaactgattgccctgaaatagacttgcatgttttggatgatggctttgggtctcccagagcacttggtttcccttggtgctgattttttctctcaggattaaagcccctttatgtgatgttgttacagcagcttattgcaacttcattcagctgcttgaaaaagaagggagactgcctctaggttccatgtgttctttcagggatggtattttgatgttgcgtattctcttgaacatgtattcttccctgagaatttctgtgtgccgtggtagaagaaatacttgccagaaatcgccactcatggtatgcttttgtagtgtcgaagtgtcccctagaggtgacaaggcttgtgatagtgttgattctaacaagcatgaatctttcctttattttagcactgtgtgttacgtgccagtaatttgcagcttatcctttgtttctagctaggtaagctgggaaatagcctagtactttgtctatgtgtttatcttcaaaatgtcccaaatagccctgggaaaaaggtcgtgcagctcaatgggggctttcaacttacaattttctttgttttaggctccataaaaatacagactcaccagttcctgctttgatgtgacatgtgactccccagaatacaccttgcttctgtagaccagctccaacaggattccatggtagctgggatgttagggctcaggtaagtaaccttcctttttttttttttagtatatgtcctggtttggccatctgttttttttttttttaaaaaaaaaaaaaaaaggaaaagaggaaaaaaatatactactcttggacagtataaaagtaccccaaagactaaagacataactgtgccaaactgtgccatataataaaaaaaagtcacttccctgagccctgaaaggtcagtgtgtgtagggttacttggtcgccacagcgtgatctgggggcgggcgtcagattagagccggaactggtgatctgcaacttcagttcaccttgaagcaggtcagctgagctgagagcgcttgcactgagcccttttgcgctgctgctgttgccttagcggtcttcagcatgtgtttgctttggtttggggtaaatggcttagtggtcaacattagtgagcagtggtaatgcattttcagatatgggaactggtatgtggttggttccctagaaggacaccctcctgaaagctgtctcagaacaccgggggccatggctaatgtcatgtgcttgctacactcctcccatggtaactaaagagagtacccagatatacatctggttcttgggactctagaggaggatgagtactttgtaaaaacctgggggccccagtcattctaggtctgacactcaggtgctgtatcagctgcagtttgaactacttggcaccattgtgtggactttagttttgtaaaaatgaatggttccttaatttctcaaccttcaggctcaacatctcaagctgtttgttgttgttgttgttgttgttgttttgttttgtctttttgattagtggtcactccgcatttgatgttttgacatgtggatttcagaacttctgtgtggtaaagcagaatgttccaattgaattttcccattttttttcccctaagcaaaaatgtgagttttcacttatgcggccattgtgattccgactgagaccctaagtcgttctttgttgtctctctagtggtttctgacacctcagtgtgaagctgttgtagacatccataagaaatagcctgcttagggattatgtgagggcaaggtttggctgaaggagaatagaaggtgtggaaggaagcggaagaccagaagagcatcacactgcctcaagtcccaaatttgattctgctcctgatcctgtgactcaaattgtcattctcttttactgctgtggggtgtgctctgggcccagctgacaggacattctttgtactccacgtatttatgctggtgggagttgtatggctagtgctttgtgctttgtctcagaaattgtgtggactaaatgtaatatgggcagtgaatgggtttcttctggaagatgttaggcctggagggtggtttgggtttttacgagtctttttctcagattacagattacgaatggatgttataaaacaggcagtgttgacaccatacagtttctcctaagaaatgtacagagagttcaacctgaggaagctaattgaaaataaacttttaaaaagaaatgtagaaagaggaaatttaaaaagtatcttatgaatgggaaagatgtagccatttgagcttcaaagaacttttgagggaattctcaaaggacagtacccgtctttagtagataaatgcttgatatctatttttcttcttttactttttaaagaattactaaaataatacatggatttatagaaaaatcaaaccacttaaaaattgatcaggtggctgggcaaggtggctcatgcctgtaatcacagcgctttgggaggcctaggcgggtggatcacctgaagtcaggagttcgagaccagcctggctaacacggcgaaaccccatctctattaaaaatacaaaaattagctggccatggtggcttgagcgtgtagtcccagctactcggaaggctgaggcaggagaatcacttgaacctgggaggcggaggttgcagtgagccaagatcacaccactgcactcctgcctgggtgacagagtgagactcggtctcaaaaaaaaaaaaaaaaaaaagtatcaggtaaaaaaatgaaagctccccgcttaatctctgctcccactacccagaataactgctgttaatagcttaatgtagatccttctaagtcttctaagactaaactgtgtactttttgtgttgtaattaacaggagggtttttgttttgttttgttttttctttttttgagatggagtcttgctctgtcatccaggctggagtacagtggcacaatcttggctcactgcaacctccacctcctgggttcaagtgattctcctgcctcagcctcctgagtagctgggattacaggcgcctgccaccacacccagctaatttttgtatttttagtagagatgggtttcaccatgttggccaggctggtgtcgaactcctgacctcaggcgatccacctgccttggcctcccaaagtgctgggattacaggcgtgagccaccgtgcctggcctcaggatggtgttatatatacatattctgcatttttccatctcatatattcatctctgcctcatttcttttaaatagcagtgtagtccagggctgacttaccgtcatgcatttcgttgtctctctatgttattaaaaatgctacaggattgaaattcctcatgtgccagtcattttgaagaatggctgcctagacttggaatttctggtggataccaccacatcactgtccaaaatggctatcccagttcccacaacagtctgagaaagtgccattttcccatatcgtcccagaattggatatacatcttttaaattggtgccgcttggattattactgaggctaaacctcaataatcattgtcatagctcttaatgtattaaagatgttaactctttgtcatgcagatattttcctgttttgtcttacgtcttgattcttgtctttctgatatataaaatttatgttatgatttattcttttgctttcatacttaggaaatccttttttactctttttttttttttttttttttttttttgagacggagtctcgctctgtcgcccaggttggagtgcaatggcgtgatcttggctcactgcaagctccatctcccgggttcattccattctcctgcctcagcctcccgagtagctgggactacaggcgcccgccaccacgcctggctaatttttttgtatttttagtagagacagggtttcaccatgttagccaggctggtctcgatctcctgaccttgtgatccgcccgtctctgcctcccaaagtgctgggattacaggcgtgagccaccgcgccccgccaggaaatcctttcctactcttaacaacagatcaatagtcatctatattttcttcctaaaaaacctgatgatgtattatattcatacatacgtatttaatacatacaaaagggccagatgcggtggctcatgcctgtaatcccagcactttgggaggctgaggcgggtggatcacctgaggtcaagagttcaagaccagcctggccaagatggtgaaatcccgtctctactaaaaatacaaaaattagccaggcgtggtggcgggcacctgtaatctcaactactggggtgactgaggcaggagaatcgcttgaacccaggaggcagaagtttcggtgagccaagatcacgccactgcactcctgcctgggcgatagagtgaggctctgtctcaaaaataaaaaataaaaataataattttatagttaagttgccctgtgtttttcctgtgattaaaaaaaaaaatacctgttttgtatttaactttggggtgggataaggtatagcccacttagtcagttgtgtctaagccacttgatgaaccagtcaatccagtcttcacctttaacaaatgctgatttcttcaagtgagcaaaatatctcttaaactttttcctattttctctataaagttgcttttttctgaattttttctttatgaggcttgatgggcagccctatcagcagacaatcattcattcacccaacaaatatttgagtatctgcttcaagccaggggcagtgctaagccctggaagtggtatcttctccttatccgggagtggggctacagtgttcattccagaagactcaagaaaatagcagatcatcacaaaagtaggttttacataaatgaggaggaatccacagggttgtgtatatgtgtgtgtattttaaattctgacataagttggagctttagggtagactgtgacataagagtagtttgttttccaactcatgtaattgccggctgatttttgtcttgaattatgataatggtaacttctgttgaaacaattctgtattcatcttagcttggttgggatgcaataaaagttttgtactggtaaaaatgataattttcttccatgatgattttgaagcttttctgtaacacctgataaaaatagaggggccaggcatggtggctcatgcctgtagtcccagctactcgggaggatgaggtgagaggatcccatgagcccaggagttttaggctacagtgagccatcatcacaccactgtactcctgtactctagcctgggcagcctcgttctttagagtaagacactgtctctttaaaaaaaaaaaaaaagaaaaaagaaaaaaagaaaaggcttttagtgaatatatttttagggtagcaagtgtaatttttataaattgcattatttgaatctaataaataccctcaaagctgaagtcgaattctgattttgattgaaaatattttttacttaaaggaagagggatagaataaatgacacgattaaggaaaagacttcttgtataaggccggggttttttaaatgattttttgaatagttagatggacaatacggaattaaaaaggtggtgtaaaaagttatacggggctgggcacagtgactcacgcctgcaatcccagtactttgggaggccgaggtgggtggatcacctgaggtcaggagttcgagaccagcctagccaacatgacgaaacatcatttctactaaaaatacaaaaattagctgggcttggtggtatgcacctgtaatccagctactcgggaggctgaggcagaagaatcgtttgaacccaggaggcagaggttgcagtgagccaagatcgtgccattgcactccagcctgggcgacagagtgagactccatctcagaaaaataataatagaaaaaagttatatggggctgggcatggtggctcatgcctgtaatcccagcagtttgggaggctgaggcagcttgatcacttgaggtcaggaattcgagactagcctggccaacatggtgaaactccgtctccactaaaaatacaaaaattagccaagcgtggtggtgcgtgcctgtagtcccagctacttgggaagctgaggcaggagaatcgcctgaacctgggaggcagaggttgcagtgagccaagatcatgccgttgcactccagcctggacgacaagagcggaactccgtctcaaaaaaaaaaaaaaaagagttatattgtaaagtatctctgctaccctgccccaaacattcatttctttccctggaggcagccactattacctgtttctttaaaaaaaaaaaaaaattgtggccgggcacggtggctcacgcctgtaatcctagcactttgggaggtggaggtgggtggatcatgaggtcaagagatcgagaccatcttggccaacatggtaaaaccccatctctactaaaaatacaaaaaattagccgggcatggtggcgggcacctgtagtcccagctactcgggaggctgaggcaggagaatcgcttgaacctgggaggcagaggttgcagtgaactgagatcacgccgctgcactccagcctggcaacagaatgagactccatctcaaaaaaaaaagcgtgtgtgtacccgtgtgttaaatttttattataaaatatatataacaggctgggcgtggtggctcacgcctgtaatcccagcactttgggaggccgaggcaggctgatcacgaggtcaggagatcgagaccatcctggcgagcacggtgaaacctcgtctttactaaaaatacaaaaaattagccgggcatggtggcgggcgcctgtagtcccagctactctgagagcctgaggcaggagaatggcgtgaacccaggaggcggagcttgcagtgagccgagatcgcgtcactgcactccagcctgggcgacagaccgagactccgtctcaaaaaatatatatcgatatatataacaatttacagttttaatcatcttaactgtacagttcagtggcactgagtacattcacattgttgtacagccattactaccatccatctctacaacctttcgtcttgcaaaactgaaatttcatacctattaaacactaactcccacttctcccctttcccccaccccaccctctggcaactactattctactctttgtctctattggacatatttttgtgtgtttaggtttgtgtatatattttacatgtgtgtataaatacacaagggtatgtgggcgttgtgtttttacacatactataaaatattgtgcacatttgtttattttaatgtatcctgtagattatttagaatcggttcatacagagccgtatcattccttttaagggttgggtttaaatagtctgttatggatgtaccacaatttatttaaccagtttttaaattttttacttattttttttaatgtttttttagagacaggatcccactccatcacccagactggagtgcaacagcatgatcatagcttactgcagccttgaactccggggctgatgtgatcctcccacctcaggctctcttgtagctgggactacagggatgtgccgccatgcctggctaaattttttatttttatttttatttttatttttggtagacacggggtttcactgtgttgcccaggctggtcttgaactccttgggcttgagtaatcctcctgccttggcctcccaaagtgccgagattacaaccatgagccatggagcccgacaagagtagccttttatttgcagaccattagagaaaaagttgcgtgtaagtagataagcatacgaatttatcactgcaatactgtttgtagagatcacagagctgttaggctaggaagaagtttttagcagttagcactagaaagcaaaactttggaaacttccatttcatcaaaagtgacctcatctgagtagggcatgtgagggaaggacctttttactcgacaaggggaacttgccagttcttgtttgtgaaccttgaagaaagtggagcatttttattttgggaccattctaggttgtggtagttccttggtactcggggttggagaatctccctctgctgctggaccttctgcctcctcatgctgtaatatgcataagaggtgtcctagaagtattcaggaacaggctgtggttgctttgttgttctgtgactgttgaactctttatatagcagtacttttttaagctgtactaattgagcatttattatgtgtcagttactgtgctagctgctggaaactatcctaccctcagcagtcttctggtctaatgggaggtacagacaggcaaatgggctatgactttacaagaggctaacttctgtgatggagagaagttccagccactaagggagcacataaaaatcagaggagatcctaccaagaattgggaggtaggtcagggaggagacttctttgaaaaatggcatctaagacctgaacagcaaggaaacattagctaggtcaaggacaaagcatcagtggggagagatgcatgagtcttttggaaggaccagcatgtgtagaggctctgacaggagagaatctctcaggcccattcagagagtccactgtgtgaagacgaggcatgaacaaccagccaggacatgtggagaggagcatttttctttttttcttttttctttcttttttttttttttttttttttgagacgtctttctctgtcacccaggctggagtgcaatggcatgatctcggctcactgcaacccccacttccagggttcaagcaattcttctgccttagcctcccaagcagctaggattacaggcacccgccaccatgcccggttaatttttgtatttttagtagagacggagtttcaccatgttggcctcaaactcctgaccttaggtgatccacccgtctcggcctcccagagtgctgggattacaggtgagagcccccacgcccggccaggctcggctttctttccaggccccgtcacactcttagatgttccctgggccccagaaggcagcgtgaggtgctctgcccatctatgctgtccttttccaccccaccctatccactgggcccctggggctcccactccactccaggtctcttcatggacccttctttcccttcacttctgtcccaggagacctgggagactcatgggaacaggcatcatcttctccagcacagttcattgtctaatgcacgaaagtgctgggctgtgagaaggtcaggagcttacatggaatgggagtcagctgtggtacaaagtacgctgcttagttctactgattttttattttttatttttacataagactttgatggtaaaggaagcagtgtgtgagcaagctgactcctgtcttgtcaagtaccaggtccactctgatgagcccctgtggacagcactgctgtaactccccaagcctgggctcaggaggtgggccctaagcgctgttcccagctcttcctccatgctgtcagctcttccaccattcttcctggcgtcattctaaggtcctgtcttcccccgccctcttccttcctggcttctacgctcagctcaagtagtagctgtttgggtacttttcacccagacttaggaaatgttatcagttggtcgtattcctgtcagccctcttactatggaactcaaataggacagattcagctgaattcccagccctgtggttgcactctttgtctgccctgcttccccaaggtagcctgctccctaaaggtcaccgagatactccccatgcaaggtttttgttgtattacacatgacaacatggaataaagtgttttgcaaatttactggatgatatcctactatgtggaacatcctacaacttactcttttcactcaacatttgacttttgaacctggtctgtattgctccgtgcagaccaatgttcattcatttgatatgtctccttgtgccatagaaatagttttacaatagaagcctgtccagagccatgagggagaaggggattgtagagaaacaaggattggcatctggtttatgtttacatcctttagtcctgttaaccgagaagaagatatttttatttccatgtttgcgaaagctttccacaaaaaaaagcatccattttctagacttattaatagggcagtccaaaggttttatttttagatttgaaagaaagcaaagtaggcttctgagatatgcacatttccctgtgtccctgtctcttttgcaacattccacattgctgctaaaacttgaacatgagcactttcaagcatgtgcttactttctatgtatgactcattttttaaaacattaaagcattttcggccgggtgtggtggctcacgcctatattcctagcactttagaaggccgaggcgggtagatcacttgaggtcaggagttcaagaccagcctagccaatatagtgaaaccccatctccactaaaaatacaaaaattagccgggcatggtggcgggcgcctgtaatcccagctactcgggaggctgaggcaggagaattgcttgaacccaggaggtggaggttgcagtgagcagagatcgagccactgcactctagcctaggtgacagagcgagactctgtctcaaaaaaataaaaataaagcattaaagcactttgtctggtggtatgtaagttttggcattacttagataagttgtattttaagtctttctacacacaataacttatttttaaaatacaagtttctgtgtacttccgggttttgtgtttttgtaaacagcagaaggtattagtccatattaagtactaatttgttctaatattttcagctgtttttggaattacacttggcaaaaaaatagacaaatgtctgcagttgtgacagtttgtttttttgttctttttaactccagaataaataattctagtgagtttttttcttggcttgtaagaacatgggaatgattagagtcatcataacacttaagtagttatagaaggttgaacatctgtagtcagttgtataaaatttcctagtcatccttccaggttgtttaagacaaacaaatacatagtatttattaagctcttataaattttaattgtaaaacatcattgtacaaaactttgaaaatgcgtataggtacaaagataaaaaattaggccaggcatgccatggctcacgcctgtaatcccagcactttgggaggccaaggtgggaggatcttttgagcccaggagttcaagaccagcctgagcaacatattgagaccctatctctacaaaaatatcataaaacaaaatagaatcactctggcgattccactatccaaaaaaaaaaaaaactgctgttaatatttggtatgtatctttctagaccaaggcctccaactttggttgagaattcagccgggtctgtgaccttggatgggaaaaacattcactctttattttcactaatgtctctgaaaacccagatttttagctgggcatggtggctcgtgcctgtaatcccagtgctttggaagcccgtggagggcagatcacttgagcccaggagtttgagaccagcctgggcaacatagcaagaccctgtcttttaaaaaaaaaaaaaatccagccgggtgtggtggctcatgcctgtaatcccagcactttgagaggctgaggcaggcagatcacctgaggtcaggagtttgagaccagcctgaccaacatggtgaaatcctgtctctactaaaaatacaaaaatcagccgggcatggtggtgggcgcctgtaatcccagctactccggaggctgaggcaggagaatcacttgaacccggaaggtagaggttgcagtgagccaagatcacaccattgcactccagcctgggcgacagagcgagactctgtctcaaaaaaaaaaaaaaaaatccacattttcttcaatgacaattgtaagcaacagatcatggtagtattagaatagcagtgactgtcaccagtagagatcaaagatactttcatatcatattatagttgttacagatattttgaaatatatatgtccatcactgcttcaaacttaaggtaattattagacccatctctagatctggttatttaatgatttactgaagaagcacatattatttgagaacgaactcttgaaatatgttgttaatttctgtgcattttacacatttcaaaacattcttctgaggaggggtccagaaggccaaaagggtccatggcagaaaaaggttaagaacacctgttctgtactttgtaccatgtggctacaaatataaaaacagacgttaagccgggtatggtgatgcacacctgtagttccacctacttgggaggctgaggtgggaaaatcacttgagcccaggagtttgaggccagcctgggcaacagagcaagaccccatctcttaaaaaccagtcagcacttgactagtcagttagtgggggaaaacacaggtacagtaaaaggagtcaaaattacacttaaacttaggtcatcttattatatcaaacatttattaacatgtttagtgttttgtgtatattatgcaaagtgtaatgcaactaaaactgtttaacacttctcgatatcacataaatttgttggtgcataatagcctaaaagttacttttgctgttggcattttattttattacttacttatttatttatttatttatttattttgagacagagtcacactgtcgccaggctggagtgcagtggtgcgatctcagctcactgcaacctctgcctccctggttcaagcgattctcccgcctcagcctcctgactagctgggactacaggtgcgcgccaccatgcccagctaatttttgtatttttagtagagatagggtttcgccatgttggccaggatggtcttcatctcttgaccttgtgatctgcccacctcggcctcccaaagtgctaggattacaggcatgagccaccacgctgggcctgctgttggcattttaaacatccttctagagtctttcttatttgcctgtaagcacgtacacatgttgttgttgttttgagacaaggtctgtcgcccaagctggagcacagtggtgcaatcacagctcactacagcttcgacctcttgggtgcaagtgatcctcccaatcagcctcccaagtaggtgggactacaggtgtccgctaccatgcccagctaatttttgtattttttttgtagagacggagtttcaccatgttgcccagactggtctcaaactcctttgctcaaacgatccttccgcctcggcctcccaaagtgccgggattacaagtgtgcacctctgtgcctggcccacatattgttttagatgaatgagatcatatatgtacttttgtaacttgctacctttcctcaacaaaatgttgtaaatatccatgtccataaaaatagacgtatatcttcacttttccctaaaatgaaaataacttaacttgcattttcttttttgtttttgtttttgttttgagacaggctcttgctctgttgctcaggctggagtgcagtgatgtcacagctcactacagcctccacctccagtttcaagtattccacctacctcagcctccaagatagctaagactacaggcacatgtcacgacgcctggctaatttttaaaatattttttgcagaaatgggatttcactatgttgcccaggctggcctcaaactgctggcctcaagtgatcttcctgccttggcctcccaaagtgctgggattacagtcgtgagccactgtgcccagcctgcattttcttattataaaagtaatacatgttcaatggacaaaaaattttcagaaaatatgcaaagatgaaaagtaaaaattgtccataaatctgtcatctacagataaagataacttctggataatgtttttctaccatcatttttagtaatcacataacatttcgttgtatgtctatgccttcatttaattaagaggcatttccattatttctgcatgttcatgactctgaatgatgatatgtctgcctgctgatggctacaaccctgtttctgcatttcaaacctctctcttgagctccagatttgatggcctcgtcagcatttacttgagttgctcataagtgtctcaaatttaacaagtcccagtcttgatttttttcccccttcaaacctattcctcatgttgtctctatttcagtaaacaatatcaacatccacccagttactcagtccaaaattctaggagtcatccttgattctgctctttctttttttttttttttttgagacggagtctcgctctgtcgcccaggccggactgcggactgcagtggcgcgatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctcttttttttttttgatacggagtctcattctcgtcatccaggctggagtgcagtggtgcaatcttggctcactgcaacctccgcctcccgggttcaagcaattcttctgccccaacctcctgagtagctgggcctggctaattttttgtatttttagtagagatggggtttcaccatgttggccaggctggtcctgaactcctgaccttgtgatccgcccacctcagcctcccaaagtgctgggattacaggcgtgagccactgcacccgccctgattctgctctttctctcatcatccctgatctgtcagcaagtcctgttaggccaaccacttctcagcatctgcactgccagtatgctagtccaagccacaaaacacctctcagaggtacgcaacaggactttgttgttgttgtgtgtgtgtgtgttttttttttttttacggtagaattattttataacttgaagtgtagggatgaccttccttttaaaattttatttattttcttaattttttattcccatagattttaggggaacaggtggtatttggtgacatgagtaagttctttaatggtgatttctgagattttggtgcacccatcacccgagcagtgtacactgaacccaatttgtagtcttttatccctcaccccctcccaccctttccctcaagtccccaaagtccattgtatcattctgatgcctttgcatcctcatagcttagctcccacttatgagtgagaacatacggtgtttggttttccattcctgagttacttcacttagaataatagtctctagttccatccaggttgctgtgaatgccattaagtcattcctttttatggctgagtagtattcctttgtatatatatgccacaatttctctattcactttctgattgatgggcatttgggctggttctatatttttgtaattgtgaattgtgctgctataagcatgcgtgtgcaagtatcattatgcaacgggacttcggatgacatattgaacaacttcctcactgatatccttgtgaaacgctacatatttcatgggtctgtttgttataccaacactcaattctgaatgatggaattatttcacatttagtctctttttcatctagccattatagtttagtttaaacaccaagttccattcctgctgcatgctgaaggatttgcagtacatcaggctatagtccatcaattcattccacaattgagtaagtaaggtatctatagtacctcaggccctgtgttaggcagggatggggtaacctagacagatttggtacctgtcctcatggagcttgactttagcggcagagacagatcttagataattgtaccagtacttaagtgttcagaaggacaagtatggaggtgggagccactccagtcctctacagtcacgtgctgcacaacaacgtttcaaccgacaacagagcacacatacagtggtgttcccataagattagaatgccatatttttactgtaccttttctatgtttagatatacaaatacttaccattgtgttccagtgatctacagtattcagtatagtaccatgctgtacagttttatagcccaggagcaataggctatataccgtatagcctaggtgtgtagtatgctacaccatctagatttgtgtaagaacactctctgatgttagcacaaataaatcgcccaatgacacatttctcagaacatatccctgttgttgagcgactcatgactgtacaatgggggaacagctcagcctgccttccccaaggaggcaacgccgatgcagggaaccgagggttgaacagaagtgggcaaggtgcagagaggaaaaaggctttccagatggagaagagcatgtgtgaaggccctcagtctggcaagagcttagtcctgtgtggcaggagctgaacgaggggttaggggagagtggcaaagggtccgggccatcagagaggtcaacaggggctggatcatgcaggattttgaatgttaacatcagagcgatagaaaacatgaagggtaaggtggtttgggttttgaatttttatcaaaatattgcaactactcggcaacaagttagatataacaaaagaggtcatcgtaaaaacagcagtctaccccttccccttcccttccctgactcagacatgacagcttttaactgtttctgattttagttcctttgatggttacctccaaaattaaatcatatgcttatacatctttcttgatttgccaactttagggaactgtgttaactccctgaaatgaaagagaatgacttagcttacgttacctccccatgttgaaattcatattcacatttctctgtaattttttttttgagatggagtctcactctgtcgcccaggctggagtgcagtgatgtgatctcggctcactgaaacctctgcctcccgggttcaagcaattctcgtgcctcagcctcctgagtagctgggactacaggcgcacaccagtgcactgggctaatttttgtatttttagtagaggcggggtttcaccatgttggccaggctggtcttaaactcctgacctcaggtgatctgcctgccttggcctcccaaagtgctgggattacaggtgtgagctaccatgccaagcccacatttctctgtaaattttaaacagtattttagtccatatgtcagttcccctctttttaagataaggatattaataaccctacttttccttccactttccctccttaacttctgcgtcttaaaagctgtacttgaccatacccattcttgcatttgttaacatgtgtgttctgccctgcaaccacagccaagttgtagcttaattctaaagtcgaaaataacattatttacattattacacatgtgagtattgttcttggcgagaccaaataatgaatgtgcccaggattacatttccttctttacagatctggaccactcaaaggagaatgaccaatcaaggtcaaatggattcccttttcttagactctgtcacctgcttaaaatccttgctaggatttaatctacttcatattcaaaccttggcttgcttatatagctctttgttttgcccaccatttctagttgcctttttattttgtttactattcctccttgattatgttgtaaaatgctattagcagtgctgtttatttcgtacgattcggctttttccccactgaagacctttctcttggaaggcctctgcccttctgcaatctgggcaagtatctgctctttgatttaaggttgcatatacagctgtacctggaccttctcctcactgggctcttgggttggagcccgtgtcttaaaacccatatcttcctttcacatggtttactccctcgttttctggactgcatccttaaataatgtgctcagatagagtgcatggggagtaaactgtagtggataccgttgtcacctaccccatatccatttcttctttgcccattcctaacagaatcctgatattattcacctttctaccttattcccaacttcagaaaggatccttaagtcattccacacattgcattcctttggcaactgttactggtcaaggatggacatacgatctaagttggttcactcagactgaagggaaggacttccatggcacgttcagggaagactttctctttttctctcactggagtaagtgagaaaggtgttgctgggggctcttctgtaacctcagactgagggacaaagcctgaggataaagcctgctcaccaaggaaggcggagcagagaaacgggaagaacctgggtcttgatgccgttgcttagctggtgattgcactgtggctggggcctgtcctacctgagctagggactcagataggatggactttcttactgaatgagccagcttcagttttcttttctgttacttgtaaccaaaagcattgtaacagataggtcttctgagtcactgcatgcctgaaatacctttcttctactcttacacttgattggctgagtatagggttccaagttgaaaatcattttttctcctaactttggaggcatctcttctagtatgcagagtaacaaatgcaacaaatgcctgatgccaatcttattatggttcttttgtaggtgcccttcttttctcttccttccctggaagtttttaggatttcgtctccttatttttagtgtcctgaaatctcatgagaatatgtctagagttgtgtcttgttcactcgttgtactgtggtcattcaatctgaatacttttgtcaactcttttttttaaaaaaaaattactaatttacatgctttcattttctctatggggactactgtttaactttggacctcttatattggtcttctgtcttctctcatatttttcatttattgggcggtggggggtgctctgaattttggaagatctcctgcatttattttctttttccttttttctttttttttgaggcagagtcttgctctgtcacccaggctggagtgcagtagcctgatctcggctcactgcaacctctgccttccaggttcaagcaattctgcctctgcctcccacgtagctgggattacagacctgcaccaccacgcccggctaatttttgtatttttaatagagatggggtttcaccatgttgccaggctggtctcgaactcctgacctcaagtgatccgcccgcctcagcctcccaaagtggtgtgagccaccgcacccagcctcctgactttattttctatcccttctgttaaattctttatttcagccaaacctttttttttttttttttaacttactgtgaagcctgtgtgcctactgcctagattagacaattgttaacattttggcgtattttcctggtctgtatagatagggtgcatttttatacctttttgctcaccatttaaaaggaactcacagatgtcacgacatttcacccctaagtacttcagtatacatctcctaaaaataaggacattttccaatataagcacaataccccgatcacatctttaaaagttaacaataattctctaatgttatcaggcacccactttaaattcagatttcctccaaatgtctcttatcgctgttgaggggctccaaagcaattaagatttatacattgcatttgaatatgcttcctttgtctcttatttatttatttattttattttgagacagagtctcgctgtctcccaggctggagtgcagtggtgtgatctcagctcactgcaacctccgccttccaggttcaagcgattctcctgcctcagcctcccaaatagctgggattacaggtacgcaccaccacgcccagctaacttttttgtatttttagtagagacagggtttctactaaaccatgttggccaggctggttttgaactcctgacctcaagtgatctgcccgcctcggcctcccaaagttctaggattataggcgtgagccaccatgcccagcccctttgtctcttttaacaagaacagcctacccacctctccttcacttgtgatactgactttttgaagcagtcagcccaattgtcatctagaagggcccacattttaagatacatatttttagagatggcgtgtcactatgttgcctaggctggccttgaactcctggcctcaagtaatcctcctgcctcagcctcccaggtagctgggactacaggcttgtgccaccacgactagctggcccacattttagatgtctctcttttcttgtgatataatttaacttgtttgtccatatatattacttgtagacaagaagttaggtctacaggcatgttcaggttaaacattttgggcaagaatatttcataggcagtactgtgtacttcatatagcatcagctcaccaggcacttaatggttggttaccctgtggtttgtgatgctacgttttaacacttgattaaagaaggaggtgactgccaaatctccccattgtagacatacagttttcctgtggtaattgatatataatctgtgatgtgatgctttggcaccatacaaatatcctattgcccaacagccatttgcataattattttagcattcattgatccttgcctgaaaccattattacattgggggttgcaaaatgatagtttttttaattgtcacctcttctacatttagtactgtcattcctctgtaatgaattttccctcatcaaataaggaggcattatatttcctcctaaaaagacagtatagatgcttaatctttgcctttattacatttcagagtaaggagttggtagaataatcacctcaaatggtggcaaaatatttgctgttgtgtttccttttctctttcatgtcaatatggactcatagggatttatttattaaatgttttacaattcaaattgggtcaacaagagtcccttcatgttggttcctatattctcctggcataccctcattaattagtctttgagcaatttcttgttttctggcacaagatattccatcccaatatgtgcttttcgtgtcctagaactgattccaaggagctctggttccttatagtggcaacggtatttagaatccaacatgtgggtactaaatgtgctgattcttactggggtaacattatatctaggcactttcagaggacatcgctagaaaatatattcagtttttattttttatttttaatttttttgtagagacaaggtctcactatgttgcccaagctggtttcgaactgagctcaagcgatcctcccacctcagcctcccaaagtgctgggattacatctgtcagggcaaactgctggtaaatattttcacaaaagaaaaataaaaaaaccaaagtgctgggattacagatgtgagccactgtgccctccattttttttttaagtcataaatacataatgatgtcttctatggcaatttaacattacagggttcttccttaacttttttttttttttttcttttttttgaggcagggtcttgctctattgcccaggctggagtggtgcagtggtacaatcctaattcactgcagcttcaaatgcctaggcttcaaacaatcctcctccctcagcctcccgagtagctaagactacaggtgcatatcaccatgcccagctaatttttaaaaattttttgtagagatggggggtctcgttgcgttgcccaggctggtctcgaactcctggcctcaagtgatcctcccatctcgatttcccaaagtgctgggattacaggtgtgagccaccatgcctggccaacttttatttgatctgtatatatcttttccttacactgaaaatgttgggtcttactaatgttaacatagttacttatttgctttatcttgtaatagacataaaattacaaaattataataccaatattacgataaatagctgggcatggcggcgctcgcctgtagtcccagctactcaggaagctgaggtggagggactgcttgaacctaagagtttgaagctgcagtgagctgtggttgtgccactgtactcctacccggacaacagagtgagtggggggaaaaaaaagaaataatggaagatccagagaaagccccaaatatttaaaaattaaacaatacactttgcagcttcctcacctctctcagccttcatagaattgaagagagttagggccttgcactagattaggctttgccttaaggaaatgttgtgtttgatttgatcttttatccagaccattaaaacttccttaacgtttattagtaataaggctatttcactttcatatcatttgtgtgttcactggagtagcacttttagtttccttcaagaactttgattcacaacttggctaactttggtacaagaggcctagcttttggcttctcggctttcaacatgcctctcactaagcctgatcatttggtttttggtttaaagagaaagacatatgactcttccttttacttgaatgcttagaggccattgtagggttattaattggcctaatttcagtactgtcttgtccaagggaatagggaggcccaaggagagagagagagatgggggaacagctgattggtggagtagtcagaatatacacatttatcacttaagttttgccatcttttctttttctttttcttttttttttttgagacagtcttgctctgtcacccaggctggcatgcagtggcatgatctcagttcactgcaacctctgcctcctgggctcaagcaattctcctgcctcaacctcccgagtagctggtattacaagcgtgcgccaccatacccagctaatttttatattttttagtagagacagggtttgccatgttggccaggctggtctcgaattcctgacctcaagtgatccacccgccttggcctcccaaagtgcggggattacaggcgtaagccactgccgcctggccaagtttgccaccttttttattttttttattttttgagatggagtctcactccatcacccaggctggagtgcagtgatgcaatctcggctcactgcagtctctgcctcctggattcaagcgattctcctgcctcagcctcccgagtagctgggactacaggcatgtgccagcacgcccagcttgttttttgtatttttagtagagacggggtttcaccatgttggccaggctggtctccaactcctgacctcaggtgatctgcccggctcagcctcccaaagtgctgggattacaggcgtgagccaccccgcccggccaagtttgccatcttttatgggtgcagtttgtggtgccgcaaaatgatgatagtagtaacatcagagagcattgatcacagatcaccataacaaatataataatgagaaatttgaaacattgtgaaaattaccaaaatgtgacagagacatgaagtaagcacatgctattggaaaaatggcactggtaaacttgcttgatgcagggttgccacacaccttcaatttgttaaaaactcagtatctgcgaagtacagtaaagcaaagcacaatcaaatgaggtgcgcctgcatattacaaccaagaggcttttcgcagaaacacgagtgtgcttcaacattcaaaaatcagttggtgtaattcaccacattaagataataaaggaggccgggtgcggtggctcacacctgtaatcccagcactttcagaagccgaggtggacagatcacttgaggccaggagtttgagagcagcctggccaacatagtgaaatcctgtctctactaaaaatagaaaaattagccgggcagggtggcacgcacctttagtcccagctattcgggaggctgaggcaggtgaatccttgaaaccaagaggcggaggttgcagtaagctgagatcacgccaatgcattctagcctgggcaacagtgagacccagtatccaaaaaaaaaaaaaaaaaaaaaaaagataataaaggagaaaaaccatatagtctattcaataaatacagaaaacgcatctgacaaaattcagtgccctttcatgataaaaattcagcagattagaaatagaggaagtgcatgtatgaaagagctacagatagattgtacttaattgtgaaatattgaacatgttaccccgaaaatcaggaaaaaggcaaagatgtccactctaaccacttctattcaacattatactagaggtcatagccagtataatgaggcaagaaaaaacataagaggcattaatatttaaaggaagtaaaactgtttctatttgtaggtaatgtcgaaaatgtgaaagaaactatcagaacctgctagaactaaaaagtgaattcagcaaggtctcagggtacgagatcattcaaaaactaatcagaaatgaaatttcaaatgcaatatcgttaggaataatttaataagaaatgtacaagatttacacgctgaaactgaaaatgttgctgaaagaaattaaagacctaaataaatggaatgttgtaccatgttcatcagctgaaagactaagtgtctttacagtgtcagttctcccttcattgaactgtagattcataaccccagtcataactgcagggttttttttgtagaaattgattgtaaaatgtatatggaagctgggcacggtggcttatgcctgtaaaccagcactttgggaggctgaggcagacagatgacttgaggtcaggaatttgagaccagcctggctaacatgacgaaaccccgtctctacaaaaaatacaaaaattagccagacatggtggcacacacctgtaatcccagctacttgggaggctgaggcatgagaatcacttgaacccggaggtggaggttgcagtgagccaagatcatgccactgcacgcccgcctgggcaacagagtgagactttgcctcaaataaataaataaataaaacgtatatggaaatgcaaaggacctagaacatccaaagtaaacttgaaagagaacaaaattaaggggcttatgtgatgtgactttatagtcatttgatttttaacagaggcaccagaacagtccggtgcgggaaaggaaagtcttttagcacgtgccggatgatggcaaatgacatccataccagacaaaaatgaaccttgaccttaccctaaatattagtttcttagagttgccacaaactaggtggcttaaaaccacagaaatttggctgggtgcggtggctgacgcctgtaatcccggcctttgggaggccgagtcgggcagatcacctgaggtcaggagtgcaagactagcctggccaacgtggtgaaactttgtctctactaaaaatacaaaaaacttagtcaggtgtagtggtgcacacatataatcccagctagccaggaggctgaggcaggagaattgcatgaacctgggaggttgcactgagccaagattgcaccactgcactccagcctgggtgacagagtgagactccgtctcaaaacaaaaccacagaaatttgctgtctcataattccagagtctagaagtccaaaatcaactgtcatcagggccatggtctctgtgaaacctgtaggggagtccttccttgcctcttcctagcttccagtggttggcaacctttggcattctttgatttgcagctgcattacttcaatatctgtcttcctcatcacacagcattctccatgtatgtctctgtctttacatggcctccttcttgtaagaacaacagtaatattggattggggcctgccctactccagtgtgacctcaccttaactaattacacctgcaacaacgctgtttccaactaaggtctcagtgtgaggtactgagggttaggacttcaacatatcttttttgggggacatagtccaacccatgacactacttcacaccatacataaaaattaattcatgagagattatagacctaaatgttttaaaagctaaaaatataaagcttctgcaagaaaacataggagaatatctgtgcagtccaaagaataaggttttttttaaacacaatttcactctgttgcccaggctggagtgcagtggtgcgatctcagctcactgcaacctctgcctcccgagttcaagcgattcccatgcctcagccttccaagtagctgggattacaggtgtgcgccaccatgcctggctaatttttgtatttttagtagaggcagggttttgccatgttggccaggctggtctcaaactcctgacctcaagtgatctgcctgcctcggcctcccaaagtgctgggattacaggtatgagccaccgtgccaggccaaaaaaagatttattaggatacatgaagcaatagctattaaaagaaaaaataaattggacttcattaaaatttaaaacttttggtcctcaaaagataccattaagaaaatgaaaagacagagctgggcgtggtgaggcttgcctgtagtcactactgggtacttgagaggctgaggcaggaggatcacttgagcccaggagttctaggccaacataggcaatatagtgagacagtgtctcttaaaaaaaaaaagaaaaagaaaaaacaaaagaaaataggctgagagctgtggctcatgcttgtaatcccagcactttgggagtacaaggcagatggattgcttgagctcaggagttcaagaccagcctgggcaacagtgaaatcccatctctacaaaagatacaaaaaattagccaaccatggtggcgtgcacccgtagtccatagtcccagctactcgggaagcagaggcaggaggattgcttgatcccaaggaggtcaaggctgcagtgagctgaggtcgcgccaccgcaccccagcctgggtgactgagtgagaccctgtctcaaagaaaatgaaaagacaagtccaccaagaaaacagttgagaccagtcatagaaaaaatagaaagtcatatctgacaaaggatttgtattcagaagaattcctataactcggtaataaaaagacaacctgatttttaaagggtgaaaatattttaatggatacttttttttttttttttgagacagagtctcactgtgtcacctaggctggagtgcagtggtgccatcatacatagctcactgcagactcgaactcctgggctcaagtggtcttcctgcctcagcctcctgcgtagctaggactacaagcacgtgccactatgcctggctaatttttaaattttttgtagacatgggctggtgtgtgtctgtgttgtctaggctggtcttgaactcctgggctcaagtgatcctcccacctctgccccccaaagtgctgggccaccacgcctggtgtggtgtcaccagagatgagccaccatgccctgcctgatacttttcttttatcatctgtttatttcttgtttatgggtgtttctgttctgattttatgactattctgtattctaagatttctctgagaatattatttgtttcctctaaggacagacttggtctctcttccatggggctggttcttgagccgccagggatggggggaggacctgggtagctgctgcgctgccccttctctgctgtggtggagtggcccgttgcctgcggggtctgtctctgaagggtggtttggagaagttctgtggaggcgaggcaggggtcagctcttgccccatggaccctcagagactgggaaaaggtaggcatcacctgggctgctgccagccacatcaagagcctttggggtgggtggggtgggggccggggaagggaaggttctagctgttgatttagaaaagacccattgatttcttgcctgagggaagaagtggcaccttgccactccaagtttgctctgctcaccagccccaacagcatcagcctcacctgggagcttattgaaggtgccctgccccaaagcttgtgggtcgggatctggcagtcagcagcccccaggtgttgcacacatgacagcactgcttgcccctcctctcgtctggtctggtctggtctggtctggtctggtctgagagcttctttggggctctgacaggtatacaggctctcatctgctctacagctctcttgtagtacattcctctctgttccattagtcaacatgttcttgcctacttccagcatctagaaatttgctgagtgtatcttatccgttcagaggtcctctcctgctattgcctctgttagaaatttcttccctttcatatgtctgtacttcggtttctttgaggtttgaagggtcaagtggcaattacatgtaggcagttggccatcctctggtgaaggctttaaagcccaggaataacaagatccattatgtctaaaactagcaaaaaccctacctgtcacatggtgaactgaattagaggtgatggggacagaagccagattggagtgagtggaaggtgagggagtggagattgggtatagacaactctctttaagaagttttgttgtgatggtgaccagaaaaataggagtggggtagagggggatgagggtgtttttcacgtgggtgaatatgagagcatgtttacatccttctgggaatggcccaggagagaggggagcgtgagaaggaggaaatggggacctggaggagcagactccttgtgtggaggggggaagcggcatctagagctgttgcaggaggtgggctttgagtaaatgcttcctctttggtaaagacggggaacgggaacggtagaagttgcacggaccctttgttaaagctcagaagctgagcgagaattagagcttaagtttatggagtagtcagaataaagtacccctaactgtattcttgcacagtgcaggaagccaggggtctgaaatcaagatgttgcagggctccattccccccagagcctctagcatggatccttccttgcctcttccagcttttggtggctgcctggcagtcctagactttccttggcttgcagttgcattgctccattctctgcttgtgtcttcacatggccttctctgtgtccccgtattcttctctggatgcttgtcactgtattaggcccaccctaaatccaggatgatctcatatcaagatccttcacttaattacagaagcaaagaccttccaaataaggtcagagccacagggtctgggggttaagacatacacctaactattcggggctaccatcgaacccctgtagaagcctgtccatttccaggatagcagagcccaaggaagggccagaagtccccccaaaacagttgtttgcattcaccagattctaagctataagcagatgggcagtggcagtcggtcctaatccatataccattggcaacaatagtttagttcactgtagacataatgagatgcttatcttctgctaagtagtcctcatggtaacagccatattactcctggctttgagtgacagcgctgtgctcttgtctggtgcccatatacttcagcagctggaaacaagacagtgctcatgattcaccggaaagtttctgtagttaaaatcaagtgatcccttgagtctattctaatatttgtctgtaccatgttctgtgacgagacatggaaacaaaacattaagaagtgaaagtatctttgattatgctcttgaagacaactttttgtttgtttgttttgtttgagacggagtttcactcttgttgcccaggctggagtgcaatggtgtgatctcggctcactgcaacctccgcattcccgggttcaagcgattctcctgcctcagcctcccaagtagccaggattacaggcatgcaccaccacgcctggctaattttttttattttagtagagacggggtttcaccatgctagtcagactggtctcaaactcctgacctcaggtgatccgcctgcctctgcctcccaaagtgccgggattacaggtgtgagccaccgtgcctggccgaagacaactttttaaagatgcatatgctctgggctgggtgtggtggctcacacctgtaatcccagcactttgggaggccaaggcgggcagatcacctgaggtcaggggttcaagaccagcctggccaacatggtgaaacaccgtctctactaaaagtataaaaattagccgggtgtggtggcgggtgcctgtaatcacagctactcaggaggctgaggcaggagaatcgcttgaaccccagaggcggaggttgcagtgaattgagactgtgccactgcactccagcctgggcgacagagtgagacttggtctcaataaataaaataaaataaagatgcatatatgctctgaaggctggctacattttattttttctcaaacaacttttacagtggatagtgctgtaaaagttgtttagctctggtcattttatcttttttgtgatctgcaaaaggagatccttttccttttcactgcctctaatacccaactccaatactcctttgacctcacaggcacttagaatccatcagtggctccatcttttctcagacttcacctccttcgtatccttattcctctcctttgtagcttcagtgccagtcagacgtcgttactccctggcacactacctcagcccttcggcactttcttgctttgttatattcagtcgacaaagccccagcctcatgaaattcagtcatgtctgccccatgcctgctccgtcctgaagctgaatgtgactccttcattgattccccctttaagttcatgtctaccccaggtaaacttcttgccgccaagcccacctgcatactgcagttccccggtctctcctagcccctcccaccctcctcatcagctgtcacacctccttgcagctgatatcttagttcccagagagcacagaagcaagctcaagagagtgtctacaggccagcgtctactccttcgctctgcctccctcatgctgtcacggagcgcctgtcccaggccctcactcctgttctaaggcatctctccagtcctctactgcactctcccccatcagagattcctccctcgcctgccctagaaacttgttgctacttctcccaccttgacaaaagctgctcccaaccccccacctgtctagcatctctgttttcctttaccagcaagactccagtccctgtctccacaccctcttcaaccttctccagttgttcctttgctgccacagctctgccaagctgctccatgaggtctccagtgatgaccttcatgttgttaaatctgggagctgcttgtcacttcttttcccagagctgtcgtcgtcagttaaccccaatacccatacgagacaatcctttccctcccttgagtctctgcactgatgtgcaccttctcagtgcaaaccacagcttttgtctctttctagctgaatacatgactgactgtgcttatcttagctgtcacccctgctggagcagaagctccacaggacaggattgtctccttgattcacagatgtagctcaagctcctagaacagtgcctggtgtctgtgggtcctcaggaagtcctaggtgagtgtgtgaatgtctgtcctcctcggtcttttctgtttcgcatgtgatgttggaaggcctcaggttcaggcttttcttctccaccctcactcccgaagtgattccgtccagcctcatggctcccaaatttatgtctccaggctgactgggtcacgggaactccttatcctccctagaccttctctttccctggtcttctcctttccagtaaacagcaactccaactcctgctcctcaggccagaaacctggcgctggttacctcatttgttcacaaatactgttactccacctgcaagatggatacaaaatctcatgagttcccctgcctccatggcccccaccctggtccaggtgtccagcttccctgcctctgcccttgccccctggttctttgtttagtcctgcaatattgtgctcttctgttcagaaccctccagtgggtccctgcttgctcagagtcacagcccaacaggatcacctctcttgccactctcccaccactcatgcactgcggcctcactggcctcctggctcctccctggaccctccaagtatgcccctgcctcaaggccttgacctctcctctgccctctgtcccaggtatcacacatgtctgctcaagtgtcaccttcccaatgtggccttccccgagcacacccatgtctgtaagtcaggcagcctgcctctgccccaccagttccccctgcctagcataggacttgtcaccatctgccacaagctgtgttactgcttggttttgtttgtgctctcccactcccttcccctccctccctctccccacccctatagaatctgagtcccatgaggacagagatttttttttttgcctcttcctcaatatatccccagtgcctagaatcatgcatattttaatttattgagtgaattaacaaataaattctgcagtgggacattgctctaaggttttgtcttataagagggacagaagaacatgcagcctgctctgctgttggctccttagcttctccatggctaacaggaacaatattgtttatgagataatcaaagccatagtcatgagttagaaggtacatataaaggcaaatatgtggagattgagttactttggcgggggcggaggggtgtgtagttatctgaaaacatggaacaaatcaatgagagtctaaatagcacccacatatttgcccctcttttaaaacatacctcctttatgagtgtagaatttaacagcacagtttcccagtgcagctttgcgaaacaagagaaatgaattttaaaggctgtcaggtgcctttgcaatctgtggcttagtatttgtgtaacaacatttgtgttttgccaacagatgtactgcttaaagtacccatgagaatggcctctgtggttttctactttctcggatggaaccttaggaactgattattgagaagaggctgatactgcccacctcagctcccaggcaggcttcagggccttggttactactcctttgggccctcactgacccttgcagacgtcttttgcaacctctgtagccagaagagacaactgctttctggcatgttgctctttccctaatggctttatgagcttcttgaacaccaaagcatgtgtgacttcctcacgccttcccctgtatagtatagcacccctaactgtatgtgtaaggagaaggagtgagcaattgatggcgtccccctggatctccaagggaatgggaaggggcagggtttctggattcagtcatgtggaatctggtcgttggtgtctaaatgtgcctgttacttgtgcccaatgtccaggttcaccaggaggcttagcctgctcatttccctgctagtagctatattttgggagagcattttttatgctctaattgaactttgtgggtctcagcaatttgaacaatgttttgtttttcttctggtcaggttacaaaggaaagaaaaggaatctggtgttgtaggaggtggtgtgttgtgtaattacttgttttttttttttaagtttttttatatttttgcaacaaggcaagttttctttgaataaataatgctgggagcttatcacatagaaggcatatgtgttgtactcagtacattctgaattatctgggtttatttttatctcttgaattcacttataaacaattcaaaggctgcttttttagctaacagaaataggaagagaatctcagaatctgttttgtcattttttcaatgggttgagttatagtgattatgctaactcggtggaaaagcagtgtagtgagtaaaccccacatacggcatatcatgaacattttgttgcttttttggcttctgaccatcttcatacctttttttgtgttaaaagtctccccattgtgtatatcttagtaagaggcaggtggaccctagtttctacctaagaaaacctgaagatggggttgggggcctgtggtgtacttccttctcatgctgtccatgaccactgcagtggctttgtaaggatccaggacccagggcccctcagtgggtgtcttccatttctcaagattgcctcttggttgtgagatgacggttgctgctctagtcattgcatccactcctccaggtaggaagaaagaggtcataggggaaaggcaaaatggcacttgacatcttaacttctaggcccattcaatatttccatttccatcttcacacccatcatcttgtcctagggaacaaacagcaccagcagctcagtagctataacagcaattattatttctcacacatgggtctgggtcagctgcaagatgggattcagatctgttctcaagcctgtcgttccaggacccaggagggagaagcagctgccaggggaagtctcttcgtaggcggaggtcaggagtccaagaggagtgagcagagtcacagaagcctcttaaagcctcttcttcccccatcccatcaacacgtgagcaagcccagagtcagtgggtgggaggtgtgctccgcccatagtcagtagaacaagagcaagcttgaaagagaacgatgaacaggagtgcactcggccactgtctccttagccataacgtagtcccatggtctgctgggaagcggggaataactctccttagctgagcgcagggtctcattagtaaggcagatggagaacatggatgttgggggacaactggcagtgcctgccacaggggaatggatatattccctccccttgctctctggaaactaggggatggcgatgaagcctaggtttggccaaacccattctgccttcagggactttgactcttgagggacagtgagggattagtcatggtggtggcagttgagtcacaaaaccagcagtggtggctaatgtccagtgatgacatgcaacagtgcccagggtgggtgtcccaaccagcaggtccctgcagtataaccttggctgtgtttgcagtggtgcagcctctattcctgctgcttttctgagcctagttctctagttctctctccatttccagatctgctgcccaagaactcctttgtgattgaatttaaccagagttgatttctgttgcttgaaactcaggaccttgatgcagtgtgcagggtctgggcaaggtaaaaacacactttcatgatttcgcctcaagtatagtagatgagcttaggctttttgagccaggtagccttgggattaattctcagctcttgcacctagcaggtgacctcagcaatcaagtcacttgccctccttgagcctcagtgttgccctcagttaaacattgctctcgtgtgttgctgagcattcagtgagattgtatataaagtgatcattgtgaaggtattgggacataatttgggaaagcgtcctggtctaagcttttgattggctctccatcatttgggtaatgggatagtgatttaggagtatcatagcagctcaaggggcccttctggaaagggtatgaggaaggtcagggacaagtctgaaatgaatcatcctaggcttaatgcctgtgactgggcagtgggtacaattatctcaggctagtcagtagtcatttattgtgagaatacatgggcagattttttaatttccttctcagtctagacttgaatgcaaacagttcttattgctaacttaccactagtcaccactaatgaacaaagactatgaacaggaaattcataaaagaagagatacagatggccaatgaagataggaaaagagttctgcctgctggtaatcaaagagatgcaaacgagaacaaaaatgatgccttttcacctaccaaatttgtcaagattaaaaagaaagcaaagagccagcgtcagctgatgttcatacctgcacctgctcggtagcttgctaatgttctgcctgctccacacgccaggccagcctccacggcgcagccaggtgaggcctttccttgtatacaggcacgtttggattcactgttgcataagtgagacatgtgcatgcttcacaattcaggaagtgcaaactccagagtgatgcaaggtctgagtgtccctgctgccctggtctcccagctgcctaggcctctcttcagggaacggctgcatccagggtcttgtctgtgtcttttgaggtgttctatgtacacgcagacacatctaaacctatttttattttccctgcacctgcttgggctactgtaagctgttaaatttttttttctaggaatttgtccattttgtctgactagcataaagttgttcatgttatagtttatacatttgcaacatctgtaattatgtctgctttttcattcctagtgtttgttgtttacttgtaccttctcccgtttttccttgtcttggtaaaagctcattaggttcattggtcttacaagaagcagacatgtaggcattattgccctgtattactctgtgtctcttttctagttcattaaattctgcttttgcttttatctttattattttttctatggtcttagagtacattctctgtgttttgttgttgttgttgttgttgtttgttttttgttttgagagagagagtcttgctctgtcgcccaggctggagtgcagtagtgcaatctcagctcactgcaacctccacctcctgggttcaagtgattctcgtgcctcaacctcccgagtagctgagatttacaggcatttgccccacacccggcaaattttttgtatttttagtagagatggggttttggcatgttgaccaggcgggtctcgaactgctgacgccaggtgctccacccgccttggcctcccaaagtgctgggattacaggcatgagccaccacgcctggccctaacttcttaagttataaatttggttcattgatttttctacccttttttcaaatgtaaacatttaaggctaaccctctggaactacttcaactgtatctagcaagttctgatagtattgtcactttaagttagcccaaagatattttaaattttctttgtttcttcctttgactcacatattattttaaaatgtgtttttcaatttccaagcacatggctttgggtttgttttttttttttcctagttgctctagaaaaaaaaattgactgcatgaggtggctcatgcctgtaatcccagcactttgggaggccgaggcgggcagatcacctgaggtcaggagttcgagaccagcctggccaacatgccaaaacctcgtctctactaaaaatacaaaattagccgggcatggtggcacacacctgtagttccagctactcgggaggctgaggcaggagaatcacttgaaccgggaggcagtggtcacagtgagccaagattgtgccagtgtactccagcctgggcaacaagagcaatactccgtctcaaaaaaaaaaaagaaaaaaagaaaaaatcaacttctaactaaatggcactgtgatcaaagaacttggtctgtgtgacaccagttcttgcagttggttgagaagtgctccatgacacattatccacaaccagtggacagaatatgtcaccaccaagcatgggtgcaggattctacatatattcattacctctgtcttatccgtttgttgtgaaagtattttctcttcttactgtcattttgtttacttgatttatcaactgatggaatacgtgttaaaacctactgtggtgatggacacatcagtttctccacagagtttggtcattttcattttattatttattttgaggccacattttcagttttagatacagtttcacattcctggtgtattgaaccctttggtattatgaagcgaccatactaatatgttatttttttttaaattattatttattttatttatttttctttcttttttttttttttgagacagggtctccctctgtcacccagtctggagtgcagtggtgcaatctcagctcactgcaacctccgcctcctgggctcaagtggtcctcccacctcagcctcctgagtagctgggattacaggcttgcaccagcgcgcctggctaagtttttgtatttttagtagagacagggttttgccatgttgcccagactggtctcaaactcctgggctcaagcagttcaccagccttggcctctaaaagtgttgggattacaggtgtgagccaccacgcccggccatcccagttttttattttcctcctttctgtgtctttatgcatcagtgaggtggagcttttgaaaatgtcagatagctagattttttttttttgagacggagttttgctcttgttgcccaggctggagtgcaatggcgtgatctcggctcactgcaacctccacctcccaggttcaaaacaattctcctgccgcagcctcctgagtagctgggactacaggcacgtgccaccacacccggctaattttgtatttttagtagagatgtggtttcaccatgttggccaggctggtctcaaactcctcacctcagctgatcacccgcctcagcctcccaaagtgttggaattacagacgtgagccaccatgcccagctgatagctagattttttttttttttttttttttgagacggagtcttgctctgtcgcccaggctggagtgcggtggcgcgatctcggctcactgcaagctccgccccccgggttcatgccattctcctgcttcagcctccagagtagctgggactacaggtgcccgccaccacgcgtggctgattttttttttttttttttttttgtatttttagtagagacggggtttcaccgtgtcagccaggatggtctcgatctcctgacctcgtgatccgcccgcctcagcctcccaaagtgctgggattacaggcgtgagccaccgcacccggcctcgagattttttaaaaaatccattgtctgtttcgtcctttaacatctatttgatttctgatgtatttagattcatttatagcatatttgtgcattctatttttccatattttctgttcttttaaattttccttctcctttcttgccttctcttagacttttaaaaaaattgtagtaaaatacacatcacctaaaatttaccatttttaaatgtacagttcagtggcattaaatacaaattggaggccaggcatggtggctcatgcctggaatcccagcactttgagaggctgaggtgggaggattgcttgaacctggaggtcgaggttgcagtgaggtgtgatcacactactgctatagcccaggcaacagagtgagaacctatctaaaaaaacaaacaaacaaacaaacaaacagattggcatcacacagtgtgtgtgctgctgtgctgtgctgttatcatttaacattaaaacataaacatcagcactgttatggactgaatgtttgtgtcccccaaaattccagtgttgaagctcaaacctccaatgtgatgttatttggagatggggtatttgagaggtggttaggtttagatgaaatcaggagggagggtgggtttcgcatgatgagattagtgtccttataacaagagacagcagagagcttgctttctccaccatgtgagtatgcaatgagaaggcagccatctccaagtcagaaagagagccctcaccaggggctgaatgtgctgacaccttgatcttggacttctagcctccagaactgtgagaaatttcagttgaataggccccccagtctgtactattttgttatagcttgagcagactaatacacccatgttatgaaaagctataaacatccctttaaaggccacctaacgcgtcgtattacctcatgcatcttctctgctgagctttccaaaagagtggcttaggctgggcctggtggctcatgcctgtaatcccagcactttgggaggccaaggcaggtggatcacctgaggtcaggagttcaagaccagcctgaccaacatggagaaatcccgtccctactaaaaatacaaaattagctgggcgtggtggcgcatgcctgtaatcccagctacttgggaggctgagccaggagaatcacttgaacctgggagatggagggtgcagtgagccgagatcgtgccattgcattccagcccggccaacaagagcgaaactccatctcaaaaaaaaagagtggctggccgggcgcagtggctcacgcctgtaatccccgcactgtgggaggccgaggtgggtggatcacgaggtcaggagttcaaaaccagcctggccgagatggtgaaaccccgtctctactaaaaatagaaaaactagccaggcgcagtggcaggcgcctgtaatcccagctacttgggtggctgaggcaggagaatcgcttgaacctggggggcggaggttgcagtgagccaagatggtgccactgcactccagcctgggtgacacagtgagaccccgtctcaaaaaaaaaaaaaaaaaaaaaaaaagtggcgtatgttcccggtctccacctctcattcgccagcccctgtgaccaaacccctgggattagatctccatcgggtccctcccctcaccctaacctcacatgcagtggttcctgagaagctgctgtttatctgatcacgggatccagcaggatctgagggctcattcactgaatctgtactacccaacaaggcaggcttgtccttacccacacttttcaggtgaaaacttaatcagattcaagcgtttatcttagtggcctcttcgtggtgtgtgatttccttcttgcagctctttactggctaaaactcttcactgggagttaaaccaggtgtggtccttgaccctcatcattttgtcccatctcctatgctgggctctgtatccttgtctccaagcagtctcgtgtgacagggaagttacctattattgtatggtcccctcttcttgtcacctctggtgtggcacttgttccatttcttgttcaatgaatgtgatttgtgaatgtgccacatctgtgggaggaaggcagttcgcagcaagagttgtagttcccttgctttgccctgagggccaggactttacactagatttttttgttgcattcctgcactcataaagtacacgtaaacttagaggtggtgtgttaaatgctagaacttaaaactgagttcagctaggctcaagtgccccacaatttttgtcccaccagacaatttcatgaatatctacagattgttccctcaatatgcctcaatattgaggcatattgatttggggagcacagacaagtcaaggttgatgtgcatccgctgaacatgatcttaagttgttgaagtaggtattattaatgaacgaacgtctattttagctccaagagcccctggtcttccagaagagactcccaatgatcttccagaagcagctgggcttcttttggtcctcccccacccaggtgcagtcccgttctccctgcctgggtgagtttgattcctctgccgtggaataggctaggctgctacctcttgagcctcttccaccaggccatccattaggtggcgacagagagcactaaaaggaactactatggaaataaaacttgttttgcttcttggggggaaaaaaaaagaaaaaggcttgtggggcgtgtgtgcattttagtcagattttactgtgcaaaacatttgagagatttctgccctctttctcccttccattcttctcaacccactgggcgccctaccacccctgtctccttcaagataaggtagatcagaagaccaaatagacaaatgccatgtccactgttttctgtcacagttgatagccataccagtcacccaagctggaaacccaacaggcccctgcccttcactgcccacatccaagggagccaccaagtcccacaaattgttcctttaactgtttgtccctcttttgtcttctgtcatcccttctaccgctgtcctggttcaatccctcatcttgctctgggactcccatgataacttatgatctttcctccacctctctatcttccacacaatccctatcatcaatctcattcccctgctttaaacccaagagtggcaccctgtgtttgagtgacatcagggcccctcatgtggctcctgcttctctttgtggccccttctgttgctgctgcttttcttatggacatagccctcagcagtccaggactgcttgtagttcctcccaggtaccatgtttcttgcactcctggcctttgtcattggctcccctgcccaagtccccttctcttctcctttccttcccctgtggccttgccttgtcgtgcttatccttgaagaccctgtcaggtatctcttccccaaagagccctgcctaaccaccgcccccctcccccccgcgacacacacacctgggttaggccctgcctctccacgcctgtgcctcctgccaagtcctcagaggtctctgatcccatgtgcctccaggcatggcatagggggactgtgacacagcctctcggcccacagacccctgattgtgggcttgctcactgccccagtcagtcctcttattgaggattccgtgccagttcctgactccagcacacacacgcatgtaggccgccctcctagtgcctggctccttccctgtctcttctgccactcattcccatggtcgtatcctggagttggtcatctctggaactccacccacggagttctaacttagctctgcctatgatgaggacttactgtcttcccagcttgcagtgtcaaccactgtttgatgcccctgggactccattggtcttccctcctcttgtgaactgtgcccatcaccagacgaacttgttttagaatttaccatcgtaactgagctcccttcagcgcatacctccttggctcctgctcagtctctgtttctccttttagccaaactctctaagagttctctccactcatgggccctcttccttgcctgctgctccttgctcagcttgctccatgaacacttgcttttccacattccatgaaataatcttaacagtcatcagtggctgtcactccttctcagccctttccttgtgtctcttctggtacctcatactctccaggtggccatctcacctcacatcttgaaccctctgggtttgggagaattctcacctcacgagttgatgggaggcctggcgacctctgattgtagtcactgcaaatgccagatgcttatttgcctagcttccctttcggtcagggcagcagttggcaaacggtatctcaagggccaagtccggcccactgcctgttttcgtaaatgaagctttaccaggacccagttccaccccgtcctttgtgcattgtccaagactgctctcctgtacaacagcaggtgggctggttgtgacagatactgtctggcccacaaggtggaaaatactatctggccccttacagaaagaaattacctgagttctacacgagggtgtaggtatgtaccctggcctctgccagtcagactcacatgctaggaggagcagggccaggcaggagagccgtgtctcctggcattggggctgcaggaaagacgagctcctaggccacagtgccagtggccagtgctgctgccttgcagggtcgcacaggcagtgctggctgtttggactggcttggcagaaggatttgaagtattgttcctagccaactggactcaaacctgttcctccaaccctctagggattctcttatcacccagtagccttttccccctagttttaaaaattgcagtaaaatacacaaaagataaaatgtactgccttaaccatttttaagtgtacaattctgtggtattgagcacatttatattgtgcaaccatcaccacatgcatcttcaatagcttttcatcagtccttgtctgcataaatcagctagagttggtttctattgattgccaccaataatcttgacagatatgtctgatcttccttctctgcactgactcctctttctctgtctcctctgctgattctttctcctcatcacaactccaaatagcagggggagggttgtttacacttatattcagcacgccctcacgcactcgcctggctcttcagacctctcccctgaactccagattcatacatccagctgccctttaggcctctagaaagctaaatacctcagtatcaaaaacatgagaaacggaagccagagtcctggatctctcgccctttcgctgtcccggtgcccatgcccttcagggatggcacctagaccagctccctgcatccctgcctagactctgcagtagtctcacgtggcagacccggaggtcactctcctctctggatgccctgcggacactccggttagcctcagctgcaagagcctcctcacccaaggtcacgccatttccaggacagcaccctggtgactgagcgaggtaagggtacaaggcccttatagggccttctctttgacttcttcccacctccctttatggatgtcagttcctgatgaacatcttacacctcaaaccgtgacccaacatctgcttctgcagagcccccctgtggcatcttgtgccctcctgccccactccctctactctatatcttcccatagttagaatgggctttttttttttttttttgagataaggtctccctttgtcacccaggctggaatgcaatggcacagtcacgactcactgcagcctcaacctcctgggctcaagcagtcctcccacctcagcctcccaagtagctgagactacaggtatgcaccaccacacctggctaatttttatattttttgtagagactggggtctccctatgttgcccgggctggtctcgaactcccaggctcaagcaatcctcccgccttggcctcccaaaatgcaggattacaggcgtgtaccagtgtgcccagcctcagatgggctctttgaaaaatgtttattagatcaggttactcccttgagaaaaaccctctcagaataaaacccgaagtccattacttgaaagcagagccagcttcatgggcctttgtaactgcccatgggcttgctggaacccaggcttggtttaatactctactctcaccatctcaaaattcttaatttttgaacaagaggccctgcattttcattttgcaccaggctccacaaattgtgtaactgggcctgcctcagcagccacatggaacatgatccctccttgcctatttgagctcattctctaccattctctcccttgctcacctggctcccactgctcttgctcttcctggaacttgccataatgttgctagagtcagagccttggctcttgctgctcctcattggctggacccctctttacttgacctgctccctcaccactcacttccttcagatctgtgttcagatttcgtcttctcagagaggcttttggcccctgtccatctctctgaatttacctctgacctctcccccaccaccactgcgctaagctgcctcagaactttgtagacattctgtctggtcttctgatgtttcccccttggaagaatcccaaggtgcctgaagaatgctttctttatccttgaagttgagtaggttgactagagtctggcttgctattgagcattctttatcaaattgtcctgggaacatggtgtattctttcagtctgcagatgtagtcgttgctgtttcaggtcagctctcttatggatctttgacagcatcttctgttccatttgttgagttctgtacttcagggacacaaattcctcatgttggattgtctttgtctctcttccaatgctattagctttgccgtaattggtttagcttttgtctttttcatctgcattcactttgtctaatttgattttcagctatgtatattctgtttctggctgtttttcaatgtatttattagtttcataatgatgtgttttggtctgcagtttgtttctctaggttggaaatttgtcttttcatcttattctgttttatcatcccatctttgaactcttttattgggaacatgttcttatgaagttgtggggaatttttttcccttccttgtgtattctcttcttggtgggagactttgcctttctcgtgccatctccctccctgggcctcttttttttcttctggccataatatgtttgcctagttaccatgtcacttcttttcgtcttggctcaggcttggatggctctgcatagtcgttctgtttgctttgagacagtggaggaattcttggctctctcttcccagtttcttggcatcttctcttgctgttttcccctctgagctatcgcgtgcaggcttgttatcttgtatccggagagaatttgcacgctggagggagctgcagccatgtagtcttcagccctatctggattcttctctttgttctaagaactgtgttggatgtcttactaaggctcactctagctgcacgagggatgtgtgtgccatttccatggggatagggggcacctcagtctctgggtggttccataatctgtgtatacctaagagcagttgcttcccacagagctgggctggctcactgggcactttgccatttctcctgcacctcccagctggagtttctgggtctaaaaggaaaaagtgaaggactcccacttggttgcttctctccagcttactgactgcaaattcccagggcgttgcccgctccctagggtggtttctgggggacggggcaggagcctggctttgctgctgctttgtcctctggagtcttttctcagactgctttgaattacacccctttcctttgtgtgctgaaatcttcccttcacactctccttccctgcctttcttttgtgtcttatcttactaggactggaagagggcagttgtgcaggaggtctgcatctaattccctaatccatgtgagagtgctcctgttgtgtgctttgtgacatgatggtgagaaatactccctagagcagtggctaccagaaggaagccatccccccccctgcacacacacacacacacacacacacacacacacacacacacacacactccttctggctgtcctcagatgcctattctaggtaaatgtcagattccaaagaaaatccagttgagatcttttttctttttttgagacgagagtcttgctgtgttgcccaggctggagtgcagtggcacaatctcggctcactgtaacctccgcctcctgggttcaagcgattctcctgcctcagcctcccaagtagctgggactacaggcgcgcaccaccacaccaggctaaaatttttttgtatttttagtagagacagggtttcactgtgttggccaggctggtctcgaactcctgacctcgtgttctgcccgcctcagcctcccagagtgctgggattacaggcttgagccatcgcgcccggcctccagttgggatcttgactggaatgactggtgttcaatcattatagtttccacctaatttgtatttgtacacaggacagttactaatttgttggtacttgtttgatccccagtccctagagttgtttatggggtggagcttcagtccctgctgcttcccctgtggcagcagctggagtcagggtggggacccagggtgctgctggcagattcttgagacaggtagaatctcctctatattggtgtctctctctgtcccagcagtgcccaggaaaacctggccagcctgtcactgacctctccacctagggcactggtggttcaggtccttctatttgccaccggcaaaccgtacttctgccagtctggctcttaggcccagtttctctgatcttgcagattttcttgggctctgctacggaatcctcatacctccggcaggtccctcctttgcccatgtgtttaactgtggtggaatcgtgtgagagctgcttctctcgcatggatcccagccacaccacattctacagcggttcctctgaaggcattgatagagatatttcctcctgttttgcatttcgttggtcatttcagtagaatcagggtgaaataaacatgggggctcagatgtcagcattacgaaccaagtacgtcaggcaggctgatgtggactgacctacactagtgagacgcaagatgacgaaaacaagggcactcactccaagttactgatgagatgtttggatcaaatgagccagtccttaagcagagttctctagtaaaagagatctcctttctgccctttcttgttccccaaaatgtgttgccttcatggtgaaaatttattttggcagattttctcttctttgataaaagcagccaacactttgttaaaagtctgtgaaacttatttacatgaagtatgtaaaggtaagaaaaaaacattatcaacaagaaatggagaaagccagcagctgaggacagaaaagtcatgcacagtgtcagtgtctatggaaacaggccacttggaccttgaggactaggtatttggaattggaggtgagcttggcctggtgagtctctaaccacttgtgtgtaggatcagtgtgagaaccctgctagaatatagtggcagagatgcaaggggaaatcattggagaagttaccagggaatgatgagctaatctgaaaaaaatacatgtttctaagttgggcgtggtagctcatctgtagtcccagctacttgagagcctgaggcaggaggatcgcttgagcccagcctgggcagcacagcgagaccctatctccctaaaaaaaactttttcgttgtttagttttgggatttttttttttcctggtcttttttccccctttttgtgaataacgggatctcactatgttgcccaggcagatctcgaactcctgggcccaagcaatcctcctgcctctgccttcctaagattacaggtatgagccactgtgttaagcaaaaaaacttttttaaatgaaaatcattttttaaaagacaggctttccaggggagggtattattccacttatatgaagtgtcaacagtaggcagatttgtggagacaaatagattagtggttaccaggggctgagaggagtgggagtggggagcaactgcttaatgggtaaagggttgtctttggaactagagagtagtgatggtcgcatgacattgtgaatgtactaaatgctattaatgataaattttatgttatgtgtattttaccacaattaaaaaaaaaagatcaaatgtcctcagaatagccaacaaccttccacttggctaaatgcctactcattaaacttcttgaactaaattcctttctgattgtcatggttattgtgtcctgggcttcagagtttcacattcaggttggcttggtccagtctgtcatgtatcactataggtccccacattggcctcttcctcagacggacagcccatctatctgccggggctctgtgccacagccagatagacttgctctgagacagctgtgtgggctctgagcactggccaggcatcacaaaacctatctttatgatttagaataattggtggtcagctgctgttttaatgttgttgttttttttaatttagatataattcacataccatgaaatttactcatttaaagtgtacaattcattcttcagtataattcataggctcacagaaaaaattgtttaaaaataaaatgtgcaattcagtgtcttttagtacattcacagagttgtgcaaccatcgcctctgtgtcattccagaacactttcagcacccaaaagaaaccccagacacaggagcagtcacctcttattacccgcagcccctggcaacaactcatccacttcctgtctctatggatttgcctattctggacatttcctataaatggaattatgcactatttggccttttgtgtctggcctctttcactgagcgtaatgtcctcaaggttcatctgcattgtagcatgtgtcagaatttctttcctttttgaggctgaatgatattatatcctatagataatgaggttttgattatccacccatcccttgggaatgcatatttgggttgcccccaccatttggctgttgtaaactgtgctgccatgaacactggtgtacggatatctgtttggttactggttttggttttttgtttgtttgttttggttttttgagacaaggtcttgctctgtcgcccaggctggattacagtggcacgatctctgctcactgcaacctccacctcccaggttcaagcaattctcctgcctcagtctcctgagtagctgggactacaggtagcactcaccaccatgcccggctaaatttttttgtatttttagtagagacaaggtttcgccatattggccaggctggtctcaaactcctgacctcaggtgatccacccacctcagcctcccaaagtgctgggattacagacgtgagccaccgcacccggcatagttgtggctttttgagagtgtatggctaggagtaaaattgccaggtcatatggtaactccatgtttaacatttgagaaactgccaaactgttctccacagcaggaattttttaacctgtatgtggtgggcttgtgtttcggttttcattttacacatctataaagatgagatttgctgtatggcactggttgcctgtatttggggagggttctgcttttggttggcaagaactgcattttatttaagcttagcaaaacataactggtttctcgcatcttctcaaaagtggaggattaagaaatggactgcgaattcagagcagggcagctgaacctcaggctccacccttgtagccttcaagctgaacctcattctctcttgctccctggagaccactgagacactctgcctgtgccagtttgatttctcacatttttaaagggccaaagcttgtgtctcaaagtgctatagcctttattgattcatgcagagaagcctccttgattccgtaattctgcagctaatactggaagtagaaagaattggaaacaccatctggatgacactttagggtggaagcagccagtacaagggggggctcattatttcctctggtcccagactgttcacctggagctgtagccaccaccctgcccttaggttaactgcctcgagtggtagtttagctctttgtgctgtgccgagggataactggaagtgaaaggtgctgagaaatgccatctcctgaaagtggcgagcatgagtgaatttacgaaaggttgggatattgctggggctctggaagtttctctggagctcactccaggggacagggagggggctggattccaattcaagtgaaaaatacctttcatctgccttgttcacctggcttttttgcctttttgtaaaatctgaaaacctcagggattgagtagtctttccttaactgcagttgcctgtctggccacacctgccagctgttgcttgtacccctgtaatttgcacggccttccgggcctttctcacaagatcactgcaggtcacattcatgaggaaaatgcaggcagttcctgccatcagacccctcaggatgtcatggtttggcctgaaaacaagattcctgcaactctaattttcctttgctagatcaaatgaaggatttgatctaatgtttgcattctagcagcaaaatcattgaatattttatttcttaagagccttacttcatattttgtaggtattttaagattttgtaaaggcctttctgcttcaacgtgtgatgtgtgcattcttagaaaaagatcttgtgttctgtaaatcacacaataaaaacatgagttcgtgcaggaaaaactggggcggggtggatcactccaaacttgtgtggtgtggtaactggagctcactgatgaaaccatgaacagttctggctgaaagaaccccacagtacactgaggtctgttggcatcgccgccagcaccgccccggtccctttgtgcgcgccaccacacctggctaattttttatttttagtagagagggggtttcaccatgttggtcaggatggcctcgaactgacctcgtgatccgcccacctcagcctcccaaagtgctgggattacaggtgtgagcctccgtgcccagccttcagctttttttcttaatgtctttgtgtaatatgaaggcattctctttaattgttaaaaagcttgcctaccactgcttcaaaatattactgtcagttggcatagcttctgattatattgatgtcatctcccttcttttaaacatgttaccatattggcactgtatttcccctagcccattgatcacttgagagttagtcatagtcctcgtgctgtttcactcctaaacgtttaagcatgcctttcctaagagcagacagtacagttaagacactcaggaagtttagcaatgagctaacacagaaccttacatttctccacataccccataaatgccttttttagagcctttgagcctggaatgcagagtccaggactgtgtgttgtattcgattgtgtcatcccttcagtctcctttatcagaaatgttcccccacccccttgttttctctcatcatcttgagtccagaccgtggttgcatggcacgccctctctggactcttcctgctgtctcctcacggtaagcttcagtctcctactcgtgatgctggttcatctcagcagcactgaggggcctgagctcagtttggtcgtgtgttaaggtggtgcctgccagatttctccacagaaaagggccccgtacttttatttgctcttcagcctgtgtattccttcctttcttgccagcttgtgggtggcttctctagcagcttctgtaagatactcagtttggcagttgtagttgtttcagcaggagaggtgtctgcatacctgaccaccacatggctagaagtcgatccatcctctggcgtaaccatcctccatgctactgtccctggggcactgaggccctcctcagtgacttcctccacctcatcttccgccatctccaagccaccagtgtccaacggactactgatatgtcccaaactcatcatttgtttattcaccaattcagagcccacctttttttcagcactgagctagcctctccttgctagaagcttacggtcgaaggtctccagccatcagaagaagcacgtggagcgctgcgtccgtgttgtggttattcatccagcatgtgttgagtaagggttgcacctgtgcctggcattatgcattgagcggggagatgggggttggcacgcacagtggggtgttctaagtacactgagggctcgggtgccctggctcatagagcagggagggaggcaggagcagggaaggtgtctcagaagtgccatctttttttttttttttttgggaagtggaatcttgttctatcgcctggtctggagtgcaatggcactatctcaactcactgcagcctccgcctcccaggttcaagcgattctcatgcctcagtccccgagtagctgggaccacaggcgcacaccaccacacccggcaaatattttgtatttttagtagaggcggagttttgccatgttggccaggctggtcttaaactcctggcctcaagtgatctgctcacctcggcctcctaaggtgttgggattacaggcatgagccactgcgcccggtctagaagtgccatcctaactgaacctgaaagatgaaagttctccagatgaacctgaaagttctccaaatgaaaaggtgggagggggtgacagggttaggcccagagcctctggtgacacagggtgggcatcattggtcactttttcctcgagggaggggcgtcacacgggtgatagggtgggagctataaccatgttgatagtgccgcctctgcccatctggcctggcatgccctgagccctctgtcccacctgtggaactcataagccctgacagcccactcactcctgattcattatccacacccctgtgcttccgctgtgcctggagcaagctttcttcagggggaagggaggctggaactatgttgtagttacctatttgtcctcccttccaaactgtgagttcttggaggtggaaggatgctgcaggatctggctcaggacgaaggcagttggtgaacagacacgtgtgtttttgactcacggtgatctcagacaagttcctctgtctagtcgaacttctttttttccatctgtaacactcaggagttgaataggtggtttttctgaggatacttcaactgtaaaatgtatgaacttgtgaactagctatttagttctcctcataatcaagattgtgtgtgtgtggggggttctgattagagggaggatgaagagaggtgtatggggttttttttgttttgttttctgtttgtttgtttgtttttgagatggagtctcactctgtcacccaggctggagtgcagtggcacgatttcggttcactgcaacctctgcctcctgggttcaagtgattctcctgcctcagcctcctgagtaactgggattacaggcatgcaccaccatgcccagctaatttttgtatttttaatagagatggggttttcgccatgttggccaggctggtctcgaactcctgacctcaggtgatccacctgcctcggcctcccaaagtgctgggattataggcatgagccaccacacctggcaggtttctttgaaaaagtttgtgtttcggcaaacaccataaaccccctgggggacagccttggggagtcacctggcaccctagcccagcctccctcccttgggtcctgcagtgaaggcttagtgagggtgtgcaaatgcccaggtcaccctgggactgggcaggccctctgggctaagggtaaactcatttggaatacctgttttctatcattgttttttatttgttaaatttaaagggtacaagtgcagttttgttgcgtggatatattgtatagtagtgaagtctgagctttcagtgtaaccatcacctgaatagtggacattgtacccgttaagtaatgtctcatccctcaccccctcccacccttcccagtctctccagtgtctgccattcctcactctgtccatgtgcacatgctattcagctcctgcttctaagtgagaacgtacggtatttgactttctgtgtctgagctgtgtcactgaagacaatggactccagctccatccacgttttttatcatttttacctgcactccacacccagcacaatccaggcttctttgtgggttttttgaaatttgtctttaattataaaagtagcagccagcaaattaacaaacacccatgtgcctttcattgcacagaattgaaaatcatcatactatatttgcttcaagtaatttccattagaaagaactagaatattacagtagagttaaagaccctttatttcccatcttcagtgctcttaaaagttcatttagggccaggcatggtggctcacacctataatcccagcactttgagaggcccaggtgggtggatcacctgaggtcaggagttcaagaccagcctggccaacatggcgaaaccccatctctactaaaaatacaaaaattagctgggcgtggtggtgcgcatctgtaatctcagctactcgggaggctgaggcaggagaatcgcttgaactcaggagggaggcagagcctgtatgcagtaagccgagattgcgccaccacaccccagcatgggtgacagagcaagactccgtctcaaaaaaaaaaaaaaaaaagttcattcattgtacacttagaaatagttaaaaaggtaaactttgttttgtgtgtgtgtgtatatatatatatatatatatatatatatatatatatatatatgtatttttttttgagacatatatgtgtctggtttgttcgcccaggcaggagtgcagtggcatgatcaacggctcactgcagcctcaacttcctaggctcaagtgatcctcctgcctcagcctcccgagtagctaggattacaggcacacaccaccatgcccagctaattttttttttttttttttttttttgtagagacagggttttgctatgttgcccaggctggtctcaaactcctgagctcaagcgatccacctgcctcacctcccaaagtgctgggattacaagtgtaagccaccacacctgacctgttttgtatattttaccacaataaaaagcctttaaaaccccaagcagacagttcattttcattcaggcccaactcagaatctgatcacagcggggtttcccccctttctagcgagtagctgaagaactgttttctctccttgatggtataactgtctctgtgggtgttgctcccctgccgctccagtggttttgtttttgtttttgtttttttgagacggagtcttgcgatctcagctcactgcgacctctgcctcctgggttcaggcgattcttctccctcagccttccatgtagctgggacttacaggcacctgccaccacgcccggctcatttttgtatttttagtagagacggagtttcaccatgttggccaggttgggctcgaactccagacctcaggtgatccacctgcctcagcctcccacagtgctgggattacaggtgagagccactgcacccagccggcccctcagtcttttccttctcaatcagtggcaccaccatcttcccaggctttggacatggtccctgactcacccttgcccctcacccccacactaatccacctgcgagctctgttgcttcaccacctagaccagccccaaatcctcaactgcccccaccctgggccacacctggaccactgctagaggcctctcatgggccctccctgtttttctcttgcactccccgggctttctggcacaagatgccccagaagcagaatcacatatctctcctgggagccaatctagtgtgtttactgcccctggagtgttattgttggccttagaatatgtcccactacaggtttgcagagcactgtagtcaaaagtcatttgaaataaatcttttctctgtggtatattgtcaatttgatatagaattaaatttgtttcttttcttttttcttttctttttttttttttttaagagacagggtcttggccaggcgtggtgtctcatgcctgtaatcccggcactttgggaagccaaggtgggtggatcgcctgaggtcaggaattcaagaccaacctggccagcatggtgaaaccccgtctctgctaaaaatacaaaaattagccgggcgtgatggcaggtacctgtaatcccagctactcgggaagctgaggcaggagaaggcttgaactcaggagtcggaggttgcagtgagccaagatcacgccatggcactctagcaagactctgtctcaaaaaaaaaaaaagagagagagagagacagggtcttgctctgtcactcaggctggagtgcagtgatgtagtcatggctcactgcagcctcatactcctgacctcaggtgatcgacccgcctcggcctcccaaagtgctgggatcgtaggctgaagccaccatgcctggcccgaactcatttgtttttatttgcattaagtgtaataaggttttgttacttttagtttgaattttattttgggtaatataaacatttacatgattcagaagtcagaattacactgaggcatgttcagctaggcctcactcctgtgcctgtacccttacctttttccccctaccccatgcagggaatcaatttcattagttcctggtgtgtccttccttaatacccccccttctttctttggtagaatgcagtagatatgtttgcgctttgctccctttgcttcacagtggatcctggaaatgactccatcgcagttcttagagctcttgtttagtccctttggatctgcacagtactccagtgtgtgggcgcaccataagtttattcagcaagtgccctggtgatagggatcgggggtattggaagcctttggctggtaaaaataatgttgtagcaaataacatcatgcatatgttctttgagatttctggaggtgtctctttagcatagatttctagaaggcattccttacgtcacgtttaggtttatagtttgacctcatggtgattaaggtatttgggaaatgcaaatgagagtttcgaagaagccagatctttcccattagttcactgtttttctctgacattaggaccgtccgggttctagggagcagccctggcgttaggcagtgccatgatggattgtgtagaagtagcgattcccatctgtctgctttcttggcccactctgctggtggctccccttccctccctcctttatggggagctggggagctgcctaggggtccattctcaaaggctgatctctggtgggcaacaggccacacctagctttccagggttcttcgtcatttcccattgagagctgtaagactcagagacatgaaaaggaagctctggctgggcacggtggctcacgcctgtaatcccagcactttgggaggctgaggcgggtcgatcacctgaggtcaggagttcgagaccagcctgcccaacatggtgaaaccccgtctccactaaacatacaaaaattagcctggcgtggtagcacacgcctgtgatcccagctactccggaggctgaggcaggagaataacttgaacccggcaggcggaggttgcgatgagccgatattatgccatcggcaacagagcgagactccatctcaaaaaaaaaacaaaaaacaaaacaaggcgagctctgtgctgggacagattagggacccctctttacagcaagaaagactgctctgtgggttgtaggatgcctttgtgtatgcagtggctctaggtgactctggcagccacactctgggccctaaacttctggaggaagatacaggatagggaggaactcaggggtgagtcatggtggggacaagacattccctcactctaagaccttgtcactagattggaacatctcttgcctccctacacctgacctgatggttctggagagatacgtccttgcagcttctgagtcccagcactaagcagcctttggtaacttccctacatcatttgagttctggtttcctaaggatgcttgccagtgagtgccatggtgccctcattgcacagtctgtgcagtgtagacaagaggggaagtctcttggggtagaccagccgcaaggcggtgactagcactgatgtgaaccacatgggacaggggagttgtggggctgagaacacggagggtgggagtagtcatgctcttttccagaatgaactgctaacgaagggactcgcaggtggctgctgcttctttccaagctgcccctgttgttgcagaggctctggagtcctaggaggtttcacggtggcatactcgacagagtactagagcatcatggccagatagtgatgctggggtgtggggcctcacggtggccatttctgacgagaccccaccgggccaaagtgatgtgtagagaaggagctgcttcggtcaccagaaaagaacggggaagcctcccacactagaataggtagggtgctcttctccaccggcaggaaggggatgtatggctctgcctggaccacacctttttccttgctcttccctccgcatctgctgtggccgaggccattcctcatcagggaacatgtgttagaggctcacgccacctgggaccacttgtcttatcacccccaggaccctaggcggtagtttcctgtggcctgagttagctgatatttatatagtgccattgtgccttttctcctgtgatgctcacagtaaggatgcctagatggggttacctgttgtcaagataaggaaactgaagcacagaatgctgaggtcatttgctgggttcatgtttggaaagcggcaaaggatttcagtgcaggttggctggctccaaacctgtgtgtgctttccatgacactgtactgtgtgcctcattgagcctcattctagaaaaccaaaaacacacccaaggcccggccttcacaaaggagacccctcccccatttggctccctttccagcagtcgacggcctcttgtcagccatcgagcccagagtcccttgaagtgcgactcatgctggggtggtatgctcaggagccgcagtgtttccgctcagaggaaagggctctgattctcctgcagtgctaggagacttgtgggtggccacagtgcaggtcaggcacaccggccagcaccacccacagcccaaattcctaaagaaatatttgggtcccagcttggcccgagtctctgttgtcctggggaaggacatcaagatctgagtgtatgatggcctggggccttgcatgtggtgggggtccaagcctgcctctgctcacttgttctgcagactggcatgttctctgtgatacttacatacttgtttaacacttcagggaagaaaagtcagaagaccaggacctccagggcctcaaggacaaacccctcaagtttaaaaaggtgaagaaagataagaaagaagagaaagagggcaagcatgagcccgtgcagccatcagcccaccactctgctgagcccgcagaggcaggcaaagcagagacatcagaagggtcaggctccgccccggctgtgccggaagcttctgcctcccccaaacagcggcgctccatcatccgtgaccggggacccatgtatgatgaccccaccctgcctgaaggctggacacggaagcttaagcaaaggaaatctggccgctctgctgggaagtatgatgtgtatttgatcaagtaagtaagagcaactcctatctctacagggcagggagggcagggacaaggatccctcatggagcaggaaaatgtatgtgcccagggtggggtcggggggaacataaacaatgaacactgagaccaggtgtgcttgaaatgaccgtgtacagaggtcgctgccctgagtgggaagttctcaaggtagcaggccctctatcctctccacacctcaagtctttatctggggatggaatagctgcggaagcagaggaacttgcagagctaggggttcagaggggtgaagaagcatgtttcagttctgccttttaaatgatcccaaaaaggttagcagttttcaaatgacatttgcagacagcctcatttaattccatgagaagggtgagcaaaggattatcttgttgaaactgattcctggagagactgagcaccgtacctgagttcaaacttgggaatgttctagatggtgactcaggcccaggcaccaaccagcagaatgggcctcagcctgacaacccttctgtaccaggcctgactctttggttgctgaactttggagaggcctgggggggtcagcggcaggcagacgagtgagtggctttggtgacaggtcctcaggggcagccaggcagtgtgactctcgttcaatagtaacgtttgtcagagcgttgtcaccaccatccgctctgccctatctctgacattgctatggagagcctctaattgttccttgtgtctttctgtttgtccccacagtccccagggaaaagcctttcgctctaaagtggagttgattgcgtacttcgaaaaggtaggcgacacatccctggaccctaatgattttgacttcacggtaactgggagagggagcccctcccggcgagagcagaaaccacctaagaagcccaaatctcccaaagctccaggaactggcagaggccggggacgccccaaagggagcggcaccacgagacccaaggcggccacgtcagagggtgtgcaggtgaaaagggtcctggagaaaagtcctgggaagctccttgtcaagatgccttttcaaacttcgccagggggcaaggctgaggggggtggggccaccacatccacccaggtcatggtgatcaaacgccccggcaggaagcgaaaagctgaggccgaccctcaggccattcccaagaaacggggccgaaagccggggagtgtggtggcagccgctgccgccgaggccaaaaagaaagccgtgaaggagtcttctatccgatctgtgcaggagaccgtactccccatcaagaagcgcaagacccgggagacggtcagcatcgaggtcaaggaagtggtgaagcccctgctggtgtccaccctcggtgagaagagcgggaaaggactgaagacctgtaagagccctgggcggaaaagcaaggagagcagccccaaggggcgcagcagcagcgcctcctcaccccccaagaaggagcaccaccaccatcaccaccactcagagtccccaaaggcccccgtgccactgctcccacccctgcccccacctccacctgagcccgagagctccgaggaccccaccagcccccctgagccccaggacttgagcagcagcgtctgcaaagaggagaagatgcccagaggaggctcactggagagcgacggctgccccaaggagccagctaagactcagcccgcggttgccaccgccgccacggccgcagaaaagtacaaacaccgaggggagggagagcgcaaagacattgtttcatcctccatgccaaggccaaacagagaggagcctgtggacagccggacgcccgtgaccgagagagttagctgactttacacggagcggattgcaaagcaaaccaacaagaataaaggcagctgttgtctcttctccttatgggtagggctctgacaaagcttcccgattaactgaaataaaaaatatttttttttctttcagtaaacttagagtttcgtggcttcagggtgggagtagttggagcattggggatgtttttcttaccgacaagcacagtcaggttgaagacctaaccagggccagaagtagctttgcacttttctaaactaggctccttcaacaaggcttgctgcagatactactgaccagacaagctgttgaccaggcacctcccctcccgcccaaacctttcccccatgtggtcgttagagacagagcgacagagcagttgagaggacactcccgttttcggtgccatcagtgccccgtctacagctcccccagctccccccacctcccccactcccaaccacgttgggacagggaggtgtgaggcaggagagacagttggattctttagagaagatggatatgaccagtggctatggcctgtgcgatcccacccgtggtggctcaagtctggccccacaccagccccaatccaaaactggcaaggacgcttcacaggacaggaaagtggcacctgtctgctccagctctggcatggctaggaggggggagtcccttgaactactgggtgtagactggcctgaaccacaggagaggatggcccagggtgaggtggcatggtccattctcaagggacgtcctccaacgggtggcgctagaggccatggaggcagtaggacaaggtgcaggcaggctggcctggggtcaggccgggcagagcacagcggggtgagagggattcctaatcactcagagcagtctgtgacttagtggacaggggagggggcaaagggggaggagaagaaaatgttcttccagttactttccaattctcctttagggacagcttagaattatttgcactattgagtcttcatgttcccacttcaaaacaaacagatgctctgagagcaaactggcttgaattggtgacatttagtccctcaagccaccagatgtgacagtgttgagaactacctggatttgtatatatacctgcgcttgttttaaagtgggctcagcacatagggttcccacgaagctccgaaactctaagtgtttgctgcaattttataaggacttcctgattggtttctcttctccccttccatttctgccttttgttcatttcatcctttcacttctttcccttcctccatcctcctccttcctagttcatcccttctcttccaggcagccgcggtgcccaaccacacttgtcggctccagtccccagaactctgcctgccctttgtcctcctgctgccagtaccagccccaccctgttttgagccctgaggaggccttgggctctgctgagtccgacctggcctgtctgtgaagagcaagagagcagcaaggtcttgctctcctaggtagccccctcttccctggtaagaaaaagcaaaaggcatttcccaccctgaacaacgagccttttcacccttctactctagagaagtggactggaggagctgggcccgatttggtagttgaggaaagcacagaggcctcctgtggcctgccagtcatcgagtggcccaacaggggctccatgccagccgaccttgacctcactcagaagtccagagtctagcgtagtgcagcagggcagtagcggtaccaatgcagaactcccaagacccgagctgggaccagtacctgggtccccagcccttcctctgctcccccttttccctcggagttcttcttgaatggcaatgttttgcttttgctcgatgcagacagggggccagaacaccacacatttcactgtctgtctggtccatagctgtggtgtaggggcttagaggcatgggcttgctgtgggtttttaattgatcagttttcatgtgggatcccatctttttaacctctgttcaggaagtccttatctagctgcatatcttcatcatattggtatatccttttctgtgtttacagagatgtctcttatatctaaatctgtccaactgagaagtaccttatcaaagtagcaaatgagacagcagtcttatgcttccagaaacacccacaggcatgtcccatgtgagctgctgccatgaactgtcaagtgtgtgttgtcttgtgtatttcagttattgtccctggcttccttactatggtgtaatcatgaaggagtgaaacatcatagaaactgtctagcacttccttgccagtctttagtgatcaggaaccatagttgacagttccaatcagtagcttaagaaaaaaccgtgtttgtctcttctggaatggttagaagtgagggagtttgccccgttctgtttgtagagtctcatagttggactttctagcatatatgtgtccatttccttatgctgtaaaagcaagtcctgcaaccaaactcccatcagcccaatccctgatccctgatcccttccacctgctctgctgatgacccccccagcttcacttctgactcttccccaggaagggaaggggggtcagaagagagggtgagtcctccagaactcttcctccaaggacagaaggctcctgcccccatagtggcctcgaactcctggcactaccaaaggacacttatccacgagagcgcagcatccgaccaggttgtcactgagaagatgtttattttggtcagttgggtttttatgtattatacttagtcaaatgtaatgtggcttctggaatcattgtccagagctgcttccccgtcacctgggcgtcatctggtcctggtaagaggagtgcgtggcccaccaggcccccctgtcacccatgacagttcattcagggccgatggggcagtcgtggttgggaacacagcatttcaagcgtcactttatttcattcgggccccacctgcagctccctcaaagaggcagttgcccagcctctttcccttccagtttattccagagctgccagtggggcctgaggctccttagggttttctctctatttccccctttcttcctcattccctcgtctttcccaaaggcatcacgagtcagtcgcctttcagcaggcagccttggcggtttatcgccctggcaggcaggggccctgcagctctcatgctgcccctgccttggggtcaggttgacaggaggttggagggaaagccttaagctgcaggattctcaccagctgtgtccggcccagttttggggtgtgacctcaatttcaattttgtctgtacttgaacattatgaagatgggggcctctttcagtgaatttgtgaacagcagaattgaccgacagctttccagtacccatggggctaggtcattaaggccacatccacagtctcccccacccttgttccagttgttagttactacctcctctcctgacaatactgtatgtcgtcgagctccccccaggtctacccctcccggccctgcctgctggtgggcttgtcatagccagtgggattgccggtcttgacagctcagtgagctggagatacttggtcacagccaggcgctagcacagctcccttctgttgatgctgtattcccatatcaaaagacacaggggacacccagaaacgccacatcccccaatccatcagtgccaaactagccaacggccccagcttctcagctcgctggatggcggaagctgctactcgtgagcgccagtgcgggtgcagacaatcttctgttgggtggcatcattccaggcccgaagcatgaacagtgcacctgggacagggagcagccccaaattgtcacctgcttctctgcccagcttttcattgctgtgacagtgatggcgaaagagggtaataaccagacacaaactgccaagttgggtggagaaaggagtttctttagctgacagaatctctgaattttaaatcacttagtaagcggctcaagcccaggagggagcagagggatacgagcggagtcccctgcgcgggaccatctggaattggtttagcccaagtggagcctgacagccagaactctgtgtcccccgtctaaccacagctccttttccagagcattccagtcaggctctctgggctgactgggccaggggaggttacaggtaccagttctttaagaagatctttgggcatatacatttttagcctgtgtcattgccccaaatggattcctgtttcaagttcacacctgcagattctaggacctgtgtcctagacttcagggagtcagctgtttctagagttcctaccatggagtgggtctggaggacctgcccggtgggggggcagagccctgctccctccgggtcttcctactcttctctctgctctgacgggatttgttgattctctccattttggtgtctttctcttttagatattgtatcaatctttagaaaaggcatagtctacttgttataaatcgttaggatactgcctcccccagggtctaaaattacatattagaggggaaaagctgaacactgaagtcagttctcaacaatttagaaggaaaacctagaaaacatttggcagaaaattacatttcgatgtttttgaatgaatacgagcaagcttttacaacagtgctgatctaaaaatacttagcacttggcctgagatgcctggtgagcattacaggcaaggggaatctggaggtagccgacctgaggacatggcttctgaacctgtcttttgggagtggtatggaaggtggagcgttcaccagtgacctggaaggcccagcaccaccctccttcccactcttctcatcttgacagagcctgccccagcgctgacgtgtcaggaaaacacccagggaactaggaaggcacttctgcctgaggggcagcctgccttgcccactcctgctctgctcgcctcggatcagctgagccttctgagctggcctctcactgcctccccaaggccccctgcctgccctgtcaggaggcagaaggaagcaggtgtgagggcagtgcaaggagggagcacaacccccagctcccgctccgggctccgacttgtgcacaggcagagcccagaccctggaggaaatcctacctttgaattcaagaacatttggggaatttggaaatctctttgcccccaaacccccattctgtcctacctttaatcaggtcctgctcagcagtgagagcagatgaggtgaaaaggccaagaggtttggctcctgcccactgatagcccctctccccgcagtgtttgtgtgtcaagtggcaaagctgttcttcctggtgaccctgattatatccagtaacacatagactgtgcgcataggcctgctttgtctcctctatcctgggcttttgttttgctttttagttttgcttttagtttttctgtcccttttatttaacgcaccgactagacacacaaagcagttgaatttttatatatatatctgtatattgcacaattataaactcattttgcttgtggctccacacacacaaaaaaagacctgttaaaattatacctgttgcttaattacaatatttctgataaccatagcataggacaagggaaaataaaaaaagaaaaaaaagaaaaaaaaacgacaaatctgtctgctggtcacttcttctgtccaagcagattcgtggtcttttcctcgcttctttcaagggctttcctgtgccaggtgaaggaggctccaggcagcacccaggttttgcactcttgtttctcccgtgcttgtgaaagaggtcccaaggttctgggtgcaggagcgctcccttgacctgctgaagtccggaacgtagtcggcacagcctggtcgccttccacctctgggagctggagtccactggggtggcctgactcccccagtccccttcccgtgacctggtcagggtgagcccatgtggagtcagcctcgcaggcctccctgccagtagggtccgagtgtgtttcatccttcccactctgtcgagcctgggggctggagcggagacgggaggcctggcctgtctcggaacctgtgagctgcaccaggtagaacgccagggaccccagaatcatgtgcgtcagtccaaggggtcccctccaggagtagtgaagactccagaaatgtccctttcttctcccccatcctacgagtaattgcatttgcttttgtaattcttaatgagcaatatctgctagagagtttagctgtaacagttctttttgatcatctttttttaataattagaaacaccaaaaaaatccagaaacttgttcttccaaagcagagagcattataatcaccagggccaaaagcttccctccctgctgtcattgcttcttctgaggcctgaatccaaaagaaaaacagccataggccctttcagtggccgggctacccgtgagcccttcggaggaccagggctggggcagcctctgggcccacatccggggccagctccggcgtgtgttcagtgttagcagtgggtcatgatgctctttcccacccagcctgggataggggcagaggaggcgaggaggccgttgccgctgatgtttggccgtgaacaggtgggtgtctgcgtgcgtccacgtgcgtgttttctgactgacatgaaatcgacgcccgagttagcctcacccggtgacctctagccctgcccggatggagcggggcccacccggttcagtgtttctggggagctggacagtggagtgcaaaaggcttgcagaacttgaagcctgctccttcccttgctaccacggcctcctttccgtttgatttgtcactgcttcaatcaataacagccgctccagagtcagtagtcaatgaatatatgaccaaatatcaccaggactgttactcaatgtgtgccgagcccttgcccatgctgggctcccgtgtatctggacactgtaacgtgtgctgtgtttgctccccttccccttccttctttgccctttacttgtctttctggggtttttctgtttgggtttggtttggtttttatttctccttttgtgttccaaacatgaggttctctctactggtcctcttaactgtggtgttgaggcttatatttgtgtaatttttggtgggtgaaaggaattttgctaagtaaatctcttctgtgtttgaactgaagtctgtattgtaactatgtttaaagtaattgttccagagacaaatatttctagacactttttctttacaaacaaaagcattcggagggagggggatggtgactgagatgagaggggagagctgaacagatgacccctgcccagatcagccagaagccacccaaagcagtggagcccaggagtcccactccaagccagcaagccgaatagctgatgtgttgccactttccaagtcactgcaaaaccaggttttgttccgcccagtggattcttgttttgcttcccctccccccgagattattaccaccatcccgtgcttttaaggaaaggcaagattgatgtttccttgaggggagccaggaggggatgtgtgtgtgcagagctgaagagctggggagaatggggctgggcccacccaagcaggaggctgggacgctctgctgtgggcacaggtcaggctaatgttggcagatgcagctcttcctggacaggccaggtggtgggcattctctctccaaggtgtgccccgtgggcattactgtttaagacacttccgtcacatcccaccccatcctccagggctcaacactgtgacatctctattccccaccctccccttcccagggcaataaaatgaccatggagggggcttgcactctcttggctgtcacccgatcgccagcaaaacttagatgtgagaaaaccccttcccattccatggcgaaaacatctccttagaaaagccattaccctcattaggcatggttttgggctcccaaaacacctgacagcccctccctcctctgagaggcggagagtgctgactgtagtgaccattgcatgccgggtgcagcatctggaagagctaggcagggtgtctgccccctcctgagttgaagtcatgctcccctgtgccagcccagaggccgagagctatggacagcattgccagtaacacaggccaccctgtgcagaagggagctggctccagcctggaaacctgtctgaggttgggagaggtgcacttggggcacagggagaggccgggacacacttagctggagatgtctctaaaagccctgtatcgtattcaccttcagtttttgtgttttgggacaattactttagaaaataagtaggtcgttttaaaaacaaaaattattgattgcttttttgtagtgttcagaaaaaaggttctttgtgtatagccaaatgactgaaagcactgatatatttaaaaacaaaaggcaatttattaaggaaatttgtaccatttcagtaaacctgtctgaatgtacctgtatacgtttcaaaaacaccccccccccactgaatccctgtaacctatttattatataaagagtttgccttataaatttacataaaaatgtccgtttgtgtcttttgttgtaaaaatcaagtgattttttcataaggttcttttactattggaaaagatgggcagcacgcagttttattttatttttgtaagttttttaatacatgtgaaagcaaagaatactcagcatgcctttctaagtgacgcgtttgcaccttttgttgggaagtactgtatcctgtgctgttagcattctcgataaatctctctgtgaaagtgactcaaggtctgggctttcattataagacagaagtccccctccagctcacatgacagcatggtgctgcgtttcctcattggatctggctgtccctggacacaggtagctgccttcaggcctgccacgagcggccaagggaagcctcctccatatgctggcctcgctggcccctcagcttcttccaagccagtgctctccaggcacactgctccagcgtgtgacgggaagggcctggcatgagtcagcctgcagcacaacctccctgctccagacccgtatggtaggggcaccccctaggtctggatgtgctgtggtgcttttggacacccccacccccgcaggctgtggctcctcctgtgtctcattctggccaggaccctcacgtgccctctgttgactgctaacgtggttctctgaccaggcaagggcaggctgaggggtttgcccaaagggggcccccttgttactggcttccttggctctcaggagcagcctcaccaggttggtaaggggctggaggagacaactgctcaaaggagtccagcttcacatgcacatgctagaaggtaccctcggaaggcctggccttcaaaggtagatcccagggttgaaaagtcaacttgtatgcattgagcatctcgtatgccagccctgttccgtgagctgatgggcctttgtgtgtaagtaggaccaagtgcccccgtggaggttagcatgggtgtgcagtcatttcagatacttgagttggtacatctcagtaaagtctgtcccgtgagaagccatgggtttcatggtatggttggcatcttccttgggagtggccacagtggtggtggcttcaggaaagagactccaacaggggccagctgtgggccttgggcacttctcgtttctaggaaaagtcctaagtctgtagggctaggggtggggaaccccttcgctgtcaggatcaagagggcaaggggaactgtcgctggaggagacatccagctggagaaacaaaagagtaagtctgcgttgctgcttgtggggtcttccccatctcagggcggggaccgggggtggcggtccagacaagtaatcaaggacgatgcccaggaggggacaggtacggggtggcaggagctctgccggcgggctcaggaagccttcaccacagctgcctgagctcacccttgccaaatgagggctggggcagcagcaacgcatacactcacggctgtggcgggcagcgttctcggcatatttcaggacacctaaggagactgaatggctcaaggctgctgccgtgtgcagggggctagacgtggggcgggcaggcagggctcctggtaacagccctgcaggccgcagtggagagcagggttccggcagggccgcccaggagctttcggaaggcccggccccggcccctttccgagcagcccgggcctccgccctgccctctgtccccaacgccgggagccgccgttcgtcctccagagccccgcccgggcgagcccgggaggccgatcgccgctcgcggaacccgccgggacccgggccctccccggcgcggggcgcccccgtgtgacccagcgcgcggccgcggcgcgcaagatggcggcgggcccgggcaccgccccttccgccccgccgggcgtcgcacgaggccggctcgaaggggaagtgagtcagtgtccgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcggtgggtggcggcgggctgccggggggcgggaggcgcgcgggctcctggcgccgacgcctgacgccccccgccccgcagccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctgtgagcgcgggactccgggcaccccacggctgggaggccggcgggccccacggggctcccccacccgggcctcaaccttcctttccttccttggcgtcccagggcaccctcccgccccgcttccgtccccaggcaccactgccccgaggcccagcagcatccctgcacccgccgaggccgaggcctggagcccccggaagttgccatcctcagcctccaccttcctctccccaggtaagagggcccggttgttaggctcggtggacccaaagaagagcccaccttgaccacggccacggctgtagaccctgctgctggtctctgcctgcctctcactggtgtctttatgaagcttttccaggctcccagacccattcagggcctgagctcggcctggtcccaagccctgcttccctgtggcctccaccgccatctccagccccttcttctaccaaggtaggtgtcccctgccccccagggaagattcgagacaaggaggaaggaattcagcctttgatgtagcgcagagccccagtcagccaagctgggtcagctgggaggcagctgtggtggggagagcctggagccttgggcagaagggaagagacagggaccccacctgatccaggctctcttcccacagccaggcccagagagctcagtgtccctcctgcagggagcccgcccctttccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggaggtgagtgtcgcaccctggcagggaccctggaaggccatcagataaccctcaccacttctccagcctttccccctcgcttccccacacaactccttcagccctcattctggcgtagggtccctggccccttggtggttctgggcctcgggtaggtggcactggtggcccgaaggccttcgcttcgagagcctcacgctgcccgtcttccctgccccttcccccaccgcaccctgggggctgcagaacgctgacctggagtggactgcagtgaagcagagcttcctgaccgaggtggagcagctgtccaggtgaggccagagggggagccacaccaggtcccgtggggcttcagaccgcacaccacaggacctggctcccttgggcacctgaggcctggcaggcccgggcgagctgaggccccagccagggctgcccacccagtctggcctgatggaaagtgctcccctttttcaaacaggtttcgtcacccaaacattgtggactttgctggctactgtgctcagaacggcttctactgcctggtgtacggcttcctgcccaacggctccctggaggaccgtctccactgccaggtaggctcacctggcccggcacgcttcccaggacccaaagcactcctgacacctggctggagccgggcgcggggcctagggctttcagcctgtgtgagtgggtcctgccagcaggccaggcctgcacttccagctccccagcagcacccggctcaggatttggcccacggtggggtcaatttttttttttttttttttttttttttttttgaggtggagtcttgctctgtcatccaggctggagtgcagtggtgtgatctcagctcaccacaacctccacctcccgggttcaggcgatcctcctgccgcagcctcccgagtagctgggactacaggcatgcaccaccacacctgcctaatttttgtatttttagtagagatgaggttttgccacattggccaggctagtctcgaactcctgaccccaggtggtctgcgcgcctcagcctcccaaagtgctgggattacaggcgtgagccaccacgcctggcccgacccaatgttttctatagagctctttcccaggcctctcccctttgcaagcagcgtagctggagggtctcatcagcaagccccggaggcgagggggtctggggctaccagctggaccacctacagctgagggagggcccccttgcctcctcctgcatgctgcgtttggggagagcgggaagaatgccttcaaggacttcccgaccaccagggacaaagggatgagccctgggagccgaagcccagcagattctattgaacgtgtccccagccattgcttaagaagtgcaggtcacggagactttgctcctcgttttccagaagggggaaactgaggcctagagagtgaagtggctgttccaggctgcacggtgacaggtagaaggatggttgggatcaaggaacggccatccagcaacctcccctgtccccctttgccaccccagacccaggcctgcccacctctctcctggcctcagcgactggacatccttctgggtacagcccgggcaattcagtttctacatcaggacagccccagcctcatccatggagacatcaagaggtgaggaggggcccttgagaactgccggggcagggcctgcagcaaggggggccccgcgtcctatcaatgtggggatcaggcatggcctgggacctcaacaccccggcatcgcacaggtgtgggaacgggccaaggatgggccctactgatgagcagaggcccccaggcagctggagcgctcagggcagtgccagcgctttctgtgggcaaggcaccgggctggcagcctcgagtccagccttatctaagccgggcaggtgtaggagctaggaccgggctgacgccactgtcttctctccccaagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtgagccactgacccctctgctggctcagaggaggagaagccacaggcaggcagaggtgggggctgcagagtgcactgcgggccaggggccatctgccaagaccccaggaggctgcagctccagggtccccctccctccgaggccctcctcctcaccctgcacctaactgtgtgtttgtaatttgtcttcaagtgggctctccgagttgcccgagcttcagtcccataacatctggctctgcctttgtccacacccttgtcaggcccaatccatgtccacaccagaggcctcttccctgccaaggccactgccatgctctccctcttccctctctccaggtagtgctagagaccttggctggtcagagggctgtgaagacgcacggtgccaggaccaagtatctggtgagccccttgaggcagggccaggagggacacacagctgctggcagccagcaggcacagccccagtggcggggataactggggcgcagtgcccatggatgcctctgctgccacagtggcctcatttttgaaagtaggcagggctccaaacaacttcgtttaccttgccgaggacaaacctgtctgtcctgcagacactatgggccttgtacagaccccacctgggctgggggcagggggaagggcggtcccagggcactgagacccaagctgcagtggaactcagaggactctggccggagaaaggcggtggtagagaagaagcaggccccgaggaacctcctgggccccagcaggctgcagctgagctctccgcaccgtgcagggcagcctgagctgcctcacggtcttactccactcagtctgcctcaccgtggactgtggtggggccaggagactagagacctgggttttagccccagcctgacagtggccttccagcaaattcctgctcccctgtgggcctgttttcccatatgcaaaacagacttcacagaatgtgctcagccagtaattgcttcactgcttctcctcttgtttggggcggttcctgtgtgctgtggggtctccgtcaggattcagccccgctgagaacccaggagccgggcttgagccctccttcctttcccttccccgtccgtccatccatgcatcctgctgaagaagcgcaccaggctccttgggggtccttggacttccccacttgctccccaccctgcagccaaagtgctcttttcaaaggcccctttgccttttctctgctcttggggtgaaggcccagtcccttatgtggttgaccccccaacgccccaggtccctgggactcggggcgctccctgctgcctgcttcacagccttagtatgtgccgttcgctctgcgagaaaagccaccgcccacccaggtggttcctcctggtctgtctgatttcagaactggagatggcctccggtcctgtttccaccctgggggcgcctctctgcggggcgcctctctctctggggtacctctttgtctgtggggcacctctctgtggggcgctttccttctcggctctgccctctcaggctacttcctgccttcagaccccagctccatggggctctcccccaccaggaagtcagctctgtcaaaccgggtcccagggttctgtttgttcctgtatccctagggcccagagcaccactggcccacagtaggtgtttaataaatctctagaagctactcgggaatctgaggcaggaggatcgcttgagcctgggagttggagaccagcctgggcaacatagcaagataggcatggtggtacacacctgtaatcccagctgctcgggaggccgaggtgggaggatcacgagcctgggaggttgaggctgcactgagccatgattgcaccactgcactccagcctgggtgacagaatgagtccctgtctcagaaaaaaagtaagttgtagaaagaccaagagctgtggcacagtgtctcacacctgtaacaccagcactttgggaggctgaggcgggaggatcacttgagcctacttggagaccagccaggccaacaaagcgagaccccatctcttttttttttttttttttttttatcaaaacccatacgattgagtgacaaggacctgaggactgcagctgcaggtgtggccacctggtagccatactgacagtatttatcccacagaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtagccagctgcgcactgggacggggtggccagatagaaagcccgcattccaggccttgctctgtagtgaccccatctcagcacctgctaggtctctctggagtctccacacatttcttgcttgccctttggttctgtttggggcagcgcccctctgaactgaggggccccgggcagtcctgctttgcggagcccagctccgacccccttcacatagagagaaggaaagagctgctgccgcgccccctgctgggcgcactgcactactgcatctgcctttttctgtcccctccctagtaccccacctcttctcctctggtgacagttgaaaatggagaggccccgtttgagggcagcggggcagtgagattcattttgtagaaaagaacgaggccattctcagtccttgcttttggcagccgcgcttctcagcactccctgtgatgggaacagaggggcgaggggcagagcgttcccagctgcagggtatgtcattttagagccctggggcaggtcacggacggcctggagcagccctgtggtttgcccacggggtgaccggccagggctgccatctcaccctgagagtccctcttttccacttgcaggtgtacgagaggctagagaagctgcaggcagtggtggcgggggtgcccgggcattcggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggtagctggggagacgggttcccaggagagggaccaaggcctctttgggccaaagcccctgtaagtccccaccccagccttctagaagagaaccagggccaaatgttcagctcactgtgaccttagcaaccctggtttcccctccccaggccacatccttcccaggtggagcttgctctccagccctccccccaccccattcctgaaggctgggaacaaggagggctctgtctggtagcctgagagctgggccctgcccttggacttctctgaggaattcaggcctgaggccagggaggcagggtgctaggctgcgggctggggagccacagcatgaggctaagggagtgccatctccaccccaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggtgctgccgcccaggctggcctctggggtgctcaggcgcatccgtgtcagccccaaagagcagagtgtctgtcccgactgcgctgagggcgtggggcagccgggcaggccactggctctggcgacctctagaagcccagccggccccacatgcctcccttagcaagaccctggcccactccttccctcgcctcctgacagtagcacctcctttagcccgagggtgcctgccccactctgtgctttcaggaaataggaagccccagcaggaattttccatcccaggtactatttgaagaaccactgcttaggaaccctcagctgggcgaggtggctcatgcctataataccagcacttttggaggccaagatgggaggatcacttgagcccaggaggtggaggctacagtgagctgtgatcaagccactgcactccagcctgggagacagttagaccctgtctcaaaaacaaatgaacaaacaaacaaaaaccctcaattcccacgaacgccccaggagataagggagcatggcccaggccttgagccagggcttctggcagtaggggagcctcccccatttgctaagcggactttcctcttccttctgtaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaatctcgggctctacttgtggactttgttgcaccgaaagccttgagctttcctgatgccttacacttcagggttcttgagcgtccagggtcttgttactactctgggctggccacacccagcacttcccgtgtcaggtttttcctgatgtagtccatgttttttatgctattctaaatggtatctttgattttctagttcatcatgatattatacagaaatgcaattgatgctgggcacggtggctcacgcctgtgattccagcgctttgggaagctaaggcgggcagatcacttgaggccaggagtttgagaccagcctgggcaacatggcgaaaccccgtctctacaaaaagtacaaaaattagccaggcatggtggtgcatgcctgtagtttgagctactcaggaggctgacccaggaggatagtttgagcccaggacgttgaggctgcagtgagccatgattccaccactgcactccagcccgggcaacagagggagaccttgcctcaaaaaaaaaaaaaaaaaaaaaaaaagcggttgagttttgcatatgaaccgtatattctgtgaccttgtttaaattcttttttttttttctttttttgagatggagttttgctcttgttgcccaggctgcagtgcaatggcgctatctcagctcactgcaacctctgcctcctaggttcaagtgattctcctgcctcagcctcccgagtagctgggattacaggtgcccaccaccacacccggctaatttttttgtatttttaatagagacagggtttccacatgttgaccaggctggtctcgaactcctgacctccagtgatccgcccgcctcggcctcccaaagtgctagattacaggtgtgagccactgcacctgtccctggctgtctgtatatttacttttttttttgagatggagtttcgctcttgtcacccaggctgcagtgcaatggtgcgatctcggctcattgtaacctctgcctcccaggttcaggtgattctcctgcctcagtctcccgagtagctgggattacaggcgtccgctaccacgcccgactgatttttctatttttagtagagacggggtttcaacatgttggccagtctgatctcgaactcctgacctcaggtgattcacccacctcagcctcccaaagtgctgggattacaggtatgaggcactgtgcccggctttttttttttttttttttttcttcagacaagagtcttactctgtcacccaggctgaagtgcagtggtgcaatcttggctcactgcaacctccgcctcccaggttcaagcgattcttctgcctcagcctccatagtagctgggactacaggtgtgtgccaccacgcccagctaatttttatatttttatttagtagagacaaggtttcaccatgttggccaagctggtctcgaactcctgacctcaagtgatctgcccgcctcagcctcccaaagtgctgggattacaggtgtgagccgtggcacccagcccagccttattcttttaaacaatctgacaatctctgcctttagttggtctgtttaatccatttccatttaatggttggagttaagtctatcatcttgttatttgttttctattaccccatctgttttgacttttggattaattacatatttctgggattctgttttttctctgctattggcttggtcgctctagtaattcagtgagactgctggttccgctcaggcccctttgctgaaccatggtgtgaaagtgcctccaggcagaaactcagggtacttgtaaggctcaccttctttgttttctctctggtcacagccctgcacagcctattgtccgatatctaaaaatagttgcccagtgttttaggtgtttacaactggcatcagttattccactgtggccagaattgcaagtttctcctcttttctgaggacttcttcactcataatgtcacccgacatgatcaatttcttccttgcttctggatctatttcttttctttttttttttttttttgagacagagtcactctgtcacccaggctggagtgcagcagcatgatctcagctccctgcaacctctgcctcccgggttcaagcaattctcctgcctcagcctcctgagtagctggaactacaggcatgtgtcaccaagcccagctaatgtttgtatttttagtagagacggggtttccccatgttggccaggctggtctcgaactcctgacctcaggtgatccgctcacctcggcctcccaaaatgctgggattacaggcgtgagccactgcgcccggcctctggatctattttcatcaaacatgtcctggtagcttccgttcttgaagaataaaaataaaaactcatttgacccaacaccccctccaaccacaaccctaattctctgttcctctttgtagctaaacttttcagaatccttgtctgttttctcacttgcccattccctgtgcagtccctcttcctctgcttctacccctgccactccatccaatcagcgttcatccagaacaccagggatctccgtgttgtcaaatccatccagtcctcttggactttctctcgccggtgcctactcccccaccaaccgcttgtctcttgtgacctctgtgacgctgaagtctgtgttctttctcagcgtgcgtgggctctctctacccagcctctacaaggtgtgagtccctccagacacgcctctgcgccttcttagctgcctgcactcattcccgacggtgatcttcctcattctcacggctctatcatgtccattcccaaacggcagcgcctccgtcatgctctctctcctgaggttttggccttctgatttttctcacaggcaccgtaaacttagatggccaagcagacttgggattccctttcaccatgagcttcccacctcagcgtgtgggactagttccagcgcccacccagctgcccacaccagagcctcaggagttaggcttttctgaaagactttgttagggaggtataagttaaaggtagaaaagtacacaaaccgtactcgtacagcccaatgactgttttatatgtacacggccatgtggcagccaccacatagacccacatatgaatctgctccagttatctcttgctaggtaccaagccaccccaagatgtacgggctgaaaataatggcaatgtttgttttgctcgcgagcctgtgctctgtgaggtctcagttggcagagctcacccgctgcagtcggttagccggggcagcccgatggccacgagctggaaccacccagcggctccttcgtgtccagcggaggacgctgccggggtgaggacacctccatgtgcctgtgaggctgggttctccggggagcatctcaagctagaaagcccagcggaggccacgtcatctgatggcctggcctggggatcaggtgctgccacttccccggcagcctgctcactagacgcaagcctctgaggccagtgtatgcaaggggagaggcgctgtgggccgccttttttgatgagagtagcaccagagaacatccaaacctggctttaaacacatagatagttttgcatgttctggaatttcatgtcaatgagattgtgtcgtgatttagtttggatgtgtgtccctgccccaatctccagtgctggaggcggggcctggtgggaagtgactgggtcatgggggcagatttctcatgaatgcttccgcgccatccctgggtgctgttctcatgatagttgtttaacagtgtgtgctacctccactgtccggctcttgctcccgctgtggccatctgatgtgcctgctccccctttgcctcccgccatgattggaagcttcctgaggcttccccaaaagcagatgcagccatgcttcctgtacagcctgcagaaccgtgagcccattgaacctcctttctatataaattgcccggtcttggctatttctgtacagcagtgtgagaatggattaacacacgtggtacgaactcgcgtctgcctgctattgctctgcactgttgttctgttgcagccgtgagtagcgctaagcgattgctttgccttcccaggtagcgttccattgtaagaatgggccgcatttgactctttctactcttgggcgtttggattgagtttggggctggcataaagctgttatgaacatttccgaatctgtcttgctgcacatacacactcatttctcttgggtgttgtacacatctgtatacacatgttggaacatctgatcagggagacctgatgggagctggcagtgctgcgatggccccacaccaggactcacagtgcacaaatgcctactgcgtcccctccgccttccagatcccagttccggccagtttttgtattttttgtagagatggggtcttgccatgttgcccaggctggtctcgaattcctgggctcacacgatccacccacctcagcctcccaggtagctgggactgcaggcgtgagcccccacgcctggcctggtgggttcattctcgattgtgttgatggtttggcagatataactttcaaactgttcactttaaatgtgcagtttattttatgtcaattatacctcaataaagctgtttttggccaggcacagtggctcacgcctgtaatctcagcactttgggaggccgaggcaggcagatcattaggtcaggagatcgagaccatcctggctaacatggtgaaaccctgtctctactaaaaatacaaaaaattagccaggcgtggtggcgggcacctgtagtcccagctacttgggaggctgaggcaggagaatggcgtgaacccaggagatggagcttgcagtgagtcaagatggcaccagtgcactccagcctgggcgacagagtgagactctgtcaaaaaaaaaaaaaaaaaaaaaaaagctgtttttaagaaataaaatgggccaggcgcagtggctcacgcctgtaatcccagcacttcggaaggccgaggcgggtggatcacgaggtcaggagatcaagaccatcctggctaacatggtgaaaccccatctctactaaaaatacaaaaagttagccgggcgtggtggcgggcacctgtagtcccagctactcgggaggctgaggcaggagaatggcgtgaacccgggaggcggagcttgcagtgagcggcgatcacgccactgcactccagcctgggcaacagggcaagactccatctcaaaaataaaataaaataaaataaaatgcagccgggcacggtggctcattcctgtaatcccaggactttgggaggctgaggtgagaagatcacttgaggtgaggagtttgagaccagcctggccaacatggtaaaaccctgtctctagtgaaaatacaaaaattagtggggtatgatggtgcacgcctataatcccagctactcaggaggctgaggcaggggaatcacttgaatccgggagatggaggttgcagtgagctgagatcacgccattgcactccagcctgggcagcagagtgagactctgtcaaaaaagaaagaaagagagaaaggaaggaaggaaggaaagaaaggaagaaagaaagaatgtctctttgaggcagcatattgattgattggttttattttccctctacgccagcccggcaatctttgtgtgtttatccattttcattttaatggatttgccaatatggctgtatgtgagatcttttattgtgataaaatatatacaacataatattcatctgtttaactatttataagtgtacaactcgggggcatgggctttgtttcttcaccctcaacatcctcctcctcctcctccacaccattagaccctgacccccgccaccctcctgctctggctgtgtgtgaggaccagcttaccatttgttctctgttgtcccatctgtcgttggttactttctttctctttttttgccttttctcagtgtcacttttcattattactccagcagttaccctagggattgagtctgcggtgcagtggctcaagcaacgccagagcctcccagcagcgagactgtgtttccgccgggcctcgggtgctcttgttttcgtatattttaaatcccaaaggacactattagtgttggtctaaacagcccattttttacctttctagtgcgttccatgccttcctgcagatctgtttttccacgttagatctcgctctctctctctctctcaaattactttatttcttggcagaaaatagggtcaagaaaataacaagtggataacatcatctcaataggagacattgaagaatacgagtgaacacccattctcagctccgttctgatccggacttattcctacaaacatgccacaaaccctctctgggtcccagcacatagaaggcagtgtattttgagtgaagtttgaaataacagtatgtgtctctttcatgtgtttattgagacaggatctcattatgttgcccaggctggagtgcaatggcgtgatcatagctcactgcagccttgttctcctgcccacagcccccgctttagcctctcgagtacctgggacctcaggtgcatgtcaccatgcccagctaattatttttatttttagtacagacagggtctcgctaggttgccaaggctggtctcaagcccctgagctgaagcgatcctccttcctcagcccccccaaagtactgggattacagctgagccgctgtgcccagctatcctgggctttttaacagctgtgttaagacatctacctcacacgccacaaggttcagttgtttgaagtgtgcaactccgtgtttttaatagatttacagacttgtgcaaccagcactctatttgagcatattttcatcattccaaaaagaaacactggccaggcgtggtggctcacacctgtcatcccagcactttgggaggccgaggtgggtggatcacctgaggtcaggagtttgagaccaacctggccaacacgatgaaaccccatctctactaaaaatacaaaaattgcccagtcatcgtggtgggcgcctgtagtcccagctactcaggaggcagaggcaggagaattgctggaacccaggaggcagaggttgcagtgagccgagatcatgccactgcactccagcctgggtgacagagcgagactccatctcaaaaaaacaaaataaaacaaaacaaaacaaaacaaaaacaaagaaaaaaaaacaccataccttttaatagtcactacccatttcttccccattttcccttccagctgaggcagtcactcatctcctttctgtctctatagattcacctactctgaacactccatataaatgggataatactcatgggatctttcgtgtctggcttctttcacttagcattatgattttggggttcatctgtgttgtagcatgtctcagcacgtgattctttttttttttctgagacagggcctcattctgtcacccaggctggagtgcagtggtgtgatctcagctcacggcaacctccgcctccccggttcaagcaattctcctgcctcagcctcccgagtagctgggattacaggtgtccaccaccatgcccgaccaatttttgtattttagtagagatggggtttcaccatgttggccaggctggtctcgaactcctgacctcaagtgatccacccgccttggcctcccaaagtgatgggatgacaggcgagagcccccgcgcccatgctgggttttctgtgtattttgcccacatgcgtcccttggcttttctctcagttgagtttatgatccacactcggttccactcgtgatgtttggttgggttttttactaaagatctccccaagagccatgcctgtggcaacccccagcaagtgcttgtgagcggaagctggtttcaccctgtcagcgggaggggagagacaggggacaggctggcagagggaccggaacctgtggtttctgagggacagggcagcacagagacgccactcacctagtgagaggctggaggagcgggcagacttctcgctaccgccttcacggcggagcagctgccacccgatcgcaaatgtaacagaaatggcctcacccatgcttttctgggagagaaggaaagtcagtgaatgaacaactccctcttgggttgggttttctgctgagtcactgccttaatggctaccagagacaactgacaccccctcgctaggccggtttctaaggcaaccattgagcaaggtggccagtgccaaccagcctggaatcagaagagacgcccatacccggccaccatgttgccttttttatttctctccagaatttttagagcctattttttaaaaagaaaaacaaaacaagcttttccttttaaaaaataccctctcaaaaaaaaaaaaaaaaaaaaaatccaaacagtacagacacgtacgaagtaagaaaatctccttctcagtctcccagcctccagtcccctggctaacactagctgtggccaccagtccctggtttaagtcccctctactcacgcttctctcatgattccacgcctcgccagtttcacttaacaagacaaatcgagagtgttccctggacacagatgtccctgacttttgtccttttttagagctgtatgaatgtactccatgtcatttatttcgccagcctccccaaagggtcagttcggttgttccagtttctgtgtgtgtgtgtttttgcacttaggcaagatctttaggcgagatctctatgagcagcagtcaggatctggctctgtcactcaggctggagtgcagtggtgcgatcatggctcactgcaacctcgacctcccaggttcaagtgatcctcccatctcagcctcccgaggagctgggactacagatgtgtgccaccacgcccggctaattttttatttttctgtagagatggggtctcactatgttgcccaggctggtctcaaactcctgacctcaggtgatccacctgcctcgacctcccaaagtgctgggattacaggcgtgagccaccacgcccggctgaaatgacccttttaaataaatgttgggttaaggaggaaattaaaattttaaaatagtaaatataactttatggcaatacatttgaaaagtctagattaactgaatgactttctgtgaaaaatagaaatcttcagagttgtctcaagaagtagtaaaactgcgccaagcacagtggctcacgcctgtaatcccagcactttgggaggccgaggcaggcagatcacttgaggtcaagagtttgagaccaccctggccaacacggtgaaaccacgtctctacttacaaaatacaaaatattagctgggcgtggtggcgcgcacctgtagtcccagctatccgggaagctgaacccgggaggtggaggttgcaatgagccgagatcgtgccactgcactccagcatgggtgacagagcgagactccgtctcaaaaaataaatgaataaagaagtagtaggccaggcgccatggatcacgaggtcaggagttcaagaccagcctggccaagatggtgaaaccccgtcactactaaaaatccaaaaattagccgggcatggtggtgggcacctgtaatcccagctacgtgggagggtgaagcagagaattgcttgaacccaagaggcggaggttgcagggagctgagatggtgccactgcactccagcctgggcgacagagcaagactccatctcaaaaaaaaaaaaaaaaaagccgggcgtggtggctcacgcctttaatcccagcactttgagaggccgaggcagggggactacctgaggttgggagttcaagaccagcctgaccaacgtggagaaaccccgtctctactaaaaatacaacattagccaggcgtggtggcgcgtgcccgtaatcccagctacttgggaggctgaggcaggagaatcacttgaacctgggaggcagaggttgcggtgagcagagatcgcgccattgcactccagcctgggtgacagagcaaaactctgtcaaaaaaaaaagaagtactaaaactgaatagaccatgagtcacatgtgaaaaggaattgctaggtgctaagcttctaaagggtccctctaggtccccaggctgctccatgtgacaggcacaacccatccccagtgtagaacaaattcttcttgcctttcataaggagaggtgtttgcataagatggagagccgagtaagcccaagtacagcaagaatcgagttttcccagccccgagaggccctggttggctgcagcctgatgaggtgctaggtgtggccgtctggcttcccaccctgttctgcgtctctggctaattaaactaagaaccaaatatggtctgtatttctacccatctgcagccaccaggtgctaaaagggattcccagctgccctgtctatggagcagccattcttttattcctctatcttcctaataaacttgctttcactttactgtaaaaaataaaaacaaaaaacaaaaagggattccccacccccgccccgttttcccaatttcagctgttggctgtagactccccaaaatcaccaccagaaaaacctgttgttcaggcaaagctgagtttattggactcactgcaaagaggaagaacactcccccgacagagccggcctcagatcaccagggaggaaaggaggagagaaaatgcccgaagtccgagccggcgtggggagggccgggtgggaagcatggtcagccttggacggctgggtgcagtctcgggccgggctctgcgagtctcatctttcaggagcatgggtgtgttggtcctgcaagcgaattgacttgtgctagttctcaggattgtgtggcagagcaacaggtcccagaactgtttatcacggggataggaaggcacctcgctcccggcattgttgaacacagggctaggaaacaatgctgggttcaggcttcccaaccaagatccccagcggacaacaaaaggaggacaaaagccactgcccattcccactcccctacgagcccaccaagatcacctgttgctaaagtcattgctgcctgcagtaagggagactgcaaccttgcccatgcctgagaagtttctggaagggtgaggttaaggttcatgttggaaaataagtacccttgggtttaagaaccagaatgatgccagagcgtggtgcacacctgcagtccagcattgtgggaggccaaggtagatggattgcgtgagctcaggagttcaagaccaacctgggcaacacagggagacctaatctctacaaatagtaattaaaaaattagcttgtgcacttcaaaaaaaaaaaattaagggtaggccgggagtcgtggctcatgcctgtaatcccagcactttgggaggccgaggcaggtggatcagctgaggtcaggagtttgagaccaacctggccaacatgaagaaaccctgtctctactaaaaatacaaaaattagccaggcgtggtggtgcacgcctgtagtcccagcttctcgggaggctgaggtgggaggatcgcttaagcccaggaagttgaggctgcagtgagtctagatctcatcagtgcactccagcctgggtgacagagtgagaccctgtcttaaaaaaaaaaaaaaaaaaaaaaaaagaaagaaaagaaaagacaaccaggccgggcgtgttggctcatgcctgtaatcccaacactttggaaggctgaagcgggcagatcacaaggtcaagagatcaagaccatcctggccaacatggtgaaaccccgtctctactaaaaatacaaaaattagctgggtgtggtggtgcaagcctgtagtcccagctatttgggaggctgaggcaggagaatcacttgaacccgggaggcagaggttgcagtgagccgagtttgtgccactgcactccagcctggcaacagagcgagactctgtctaaaaaaaaagaaaaagaaaagaaaagaaaaaagaaccagaataagactaattacaagcaacctgactgaaacatgatggactcgggccccacgtcttaagggggatttggcacaactcaatggggtgggggcgggcacagtcgctgggaaaataaaaccatttattgcatgtacttccaagtacatgcaagaaatgagacttactacaaagactggttacaggagtgatgtctgacagtaaaatcagacaagagcaaagcaaatgacacccagtctcagataggcccagtgaagacagccagaatctcctgactcaaacctgcccagcagaccagaggacgtttcagtggtgcaatcaagtgatttacaaagaatgagaactttgcttcatccttccaacacgtattccttgtgcgccacgtccggctaactttttcaattgcattggccaatttaacattgggaaacgggaagaaacagtggtgatcctgggaatattgtctcattcttgactaatgaaaatgctgtggtgtttcaccattaagcacagtactgtttgtggcttcatacaatcagctcatgaagctgtcatctctgcagatttcactttttttttttttttttgagatggagtttcactcttgcggcccaggctggagtgcagtggaaccatcttggcttacggcaacctccgcctcccaggttcaagcgattctcctgcctcagcctcccagacagctgggattacaggggcccgccaccacacctggctcattttttgcgtttttagtagagatggggtttcaccatgttggccaggctggtctcaaactcttgacctcaggtgatccacgtgccgtgggctcaagtgattcccctgcctcagcctcaggtagctgggattacgggtgcccactaccacgcccggataatttttgcagttttactacagacagggtttcaccatgttggtcaggctggtctcgaactcctgacctcaggtgatccacctgcctcggcctcccaaagtgctgggattacaggggtgagccaccacagctggcctttttctacttaggaagctgacgtgggagggttgactgggcccaggaggatgaggctgcatgagctgtggtcatgccaccgcactctagcctgggtgacagagtgaggtcctgtctcaaaaaaagaaaattttagtgggcaaaagatctgaatagacatggccaacaggtctatgaaaaaatgctccacatcactcaccatcagggaaacacaagtcaaaagcaccacgagatatcatctcaccccagttaaaatggcttttaacaaaaagatgtttaaaaaaataacaaatgctgacaaggatgcagggaaatgggaacctcgtacgctgttggtgtgaatgtaaagtagcacagacagtacggagaacagtatagtccaaaaactacaaacacaactaccgtattagccagcaatttcactacttggtatatatttaaaggtatatatttaaatttgaaatcaccatgtcaaagagatacctgcactcccgtgttcattgcagcactattcacaacaggtaagagatggaatcaacctaagagtttatcaatgggtgaatggataaagaaagtgtgatatctgtacacaacggaatcccattcagccataaaagagaaggaaatcctgtcatttgcaacaaaataggtgaaactggggaacactatgttaaatgaaataagccaggtacaaaaagacaaataccacacaacctcactgatatgtagaaaataaaaaagctgaactcataaaggggctgcagggtggtgggtggggagggaaggatgaggagatgttggccaagggattcaaaattccaattaggaggaattccaattagttcaagagatttgttgtacatcatcgtgactatggttaataacaatatgttgtgtacatttggttatagtttattcacttctttgctttttttaagagtcaggtgtgaaccctgaatatctgagagaggtctcagtgaatttagaaagtttgttttgccaaggttgaggatggtcctgacgacatgtgcccgaggtggtcagagcacagcttggttttatacattttagggagacatgagacatcagtcaacatatgtaagatgaacattggcttggtccagaaagggacaacttgaagtggggagggggcttccaggtcatgggtagataagagaccaatgattgtgttgttttgagtttctcatgagcctctccaaaggaagcaatccaataagcatttatctcagtgaacagaggagtggccttgaatagagtgggaggcaggttggccctaagcagttcccagcttgagttttccctttagctgagtgatttgggggccccaagatttattttcctttcacacaggtctccctctgtcacccaggctggagtgcagtggtgtgatcatggctcaccgcagcctcagactcctaggcccaagcaattctccctcagcctccgagtagctaggaccacaggctcgcaccaccatccccacctaacttttgtatttttttttagagacagactcaccatgttacctaggctggcctcaaactcctgggctcaagcaatcctcccacctcagcctcccacagtgctgggattacaggcatgagccaccgcgcccagcctggatattcatgccttgatctgcttttggatgatattagctaatgtttttattttagaaatgcctaccagtgtttaacagcagtatcgatacttttccgtgtgtgcatgtgtgtgtgtgtcaagtctgcaaccagattcagtgagtcacccaggagtacctactgtgtgccagacaccgctgtggactcagagcggagaagcaagcaggacccacaagagtctgtctttgtgacactaacattctcctgggggacaaaggttattctggcttcataaagcacatctggaaactttactttctttgaaaccctggaattacctcttttttttttttgagacggagtctcgctctgtcgcccaggctggagtgcagtggcgccatctcggctcactgcaagctccgcctcccgggttcactccattctcctgcctcagcctccccagtagctgggactacaggcgcccgccaccgcgcccggctaatgttttgtgtttttagtagacacggggtttcaccgcgttagccaggatggtctcgatctcctgatctcgtgatccgtccacctcggcctcctgaagtgcttggatgacaggcgtgagccactgcgcctcgctggaattacctgtctcttaaaggccaggaataattcactggaggattcactaggcctgggctgtctgatagccaccatttcttctctgctcagctgctggtggggtgcccctacttctcaagccgccccactgtggaaatgaaactgttccttaaaaccctgaaggccaggcacagtggcttaggcctggaatcctagtactttgggaggttgagacgggtggatcgcttgagcccaggagttcctgaccagcctgggcaacatggggagaccccgtctctatgaaaagtgacataattacataattagctgggcatggggccgtgcgcctgtagtcccagttattcagggggttgaagtgggaggatcacctgagcccggaggtccgtggtgcagtgagccgagatcgcgccactgcattccagcctgggagaaagggtgagaccctgtctcaaacacacacacacacacacacacacatgcacacacacacacacacacgcacacatgcacacatgcacacacacacacatgcacacacacacacatgcacacacacacacatgcacacacacacacacgcacacatgcacacacgcacacacgcacacacacacacacacacacacatgcacacacacacacacacacacacacccccaaacctctgcagcccacagcagtgtccacgtcttctcacctggagccagcaagtccaggagtgaagacatgatgagaggcccctacagtcactcaggatctggtgacatgagggccagacccctgcccaaaccctgaatgcaccttgcttggggttaaaatggttcaagagcaaagggcccacttccccgtccccctcctccagcacttgccacccccacccaatgctctctcctccaaccaccctccctgccttctcctgcccctcttctgcccccgtctctggttctccccactgaggcataggaagagatgcccatttctcatggggaaatgcaagataaaatcgcacccagaatgactgtcactgaagactggtcgcagggagcactggtgaggaggcggagtgcatgaaaggttcgcacgcggccagcaggagtgtgaaatggcacagccactttgaatcactgttcagcagtttcttatcaacttaaaaacttctttgcagcaagatgatcctcagtttgaatcacaaaatagaaataaacattttaaaaaagaaaactgcaagccgggcacggtggctcacgcctctaatcccagcactttgggaggccgaggcgggcggatcacaaggtcaggagatcgagaccatcctggctaacgcggtgaaaccccgtctctactaaaaatacaaaaaattagccgggcgtggtggcgggcgcctatagtcccagctacttgggaggctgaggcaggagaatccctcaaacccgtgaggcggagcttgcagtgagcccagattgtgccactgcactccagtctgggcgacagagccagactctgtctcaaaaaaaaaaaaaaaaaaaagaaaaaaaaaagaaacctccctctacgatgcttcatgtgcctatttctccctagagttctgtcaacttttgcttaagatatgtagagcctattttaacatcattcctaaactgtttttgttttgtcccaaagcctattttgtctgatgttaatatagccatggcagcttgcttttggtagtaactgcctagcattcattctttcacatgtaatatttccatggacatatgtttgaggtgtgtctctagtaaacagcatatgctggaagtgggggtttccatccaatctgacaatctccggaatctctgacaattcccaatctgaagtcctcggcagggggctacatctgctgtttgttatgtctgtcccagcagaagcccccccagcggggccggctcggcaacctgcacatctcggctccgtgtgggtgctgcgggctgagcttctccacctgttggggttgcatcctatacagagccagcggggaaggcagcctgtctggacggcgagatggagagcttcaagcagcaggggtggaagttcagatgctgagggccgggtgcagtggcctccctgtgtccacatttgacctgtggcacacctgaagggtggtttccaggggctgcaggagggggactggggagttagcatttaatggggatagagtttcagtttagaaggatgaaaagagttccggagatggacgatgatgttggttgcaccatattacgaatgtaggtaacaccactgaactaactaaccacaaaactggttaacatggtacattttatgttattatgtattttaccccaataaaaaacatcgggccaggcacagtggcctgtaatcttggcaactcgggaggctgaggtgggaggatggcttgagcccaggacaactggacaacatagcaagaccctgcctctacaaaaaaaaaaaaaaaaaaagaaagaaagaaaaaggaaagaaaaaagaagaaaaattagctgagcatgatggtgagcacctatactcctagctacccaggaggctgggatgggaggatcacttaagcccaggaggttgaggctgcagtgagctgtgatcctaccactgcactccagcctgggtgacagagccagactcagtttctaaaaaaattttaaaaatgaaaaaaattgaaaaaaatatattttcaattgaaatttggatcccaagtcacagcggtcatggtgcaagagcttcctggaatgagtgaggagcagctccaggcaaagtccaaagccccagggcaaagcccaccgcagccacttcctactgctgtgaacttggccattcaacttctctaaactgactttcgtccacagtaagccctcgatcgctgctagccagcatggcccgagacagcggtggtgagggagtggctctgcagaattacccataccagattttatgaggtcgacctaaaggaacacactgaggtaaaattaatacaaggagagtgtatttgggccaaatttgaggattgcaacctgggaaacacatccaaactaagttttggtaggtattctgagttgaggtggttacaagcagatattaaggacaaaatgaggaggctgggccccgtggctcatgtgtgccatcccagcaattggggaggctgaggcaggaggatcactggagcccaggggttcaagaccagcctgggcaacatggtgagactccatctctacaagaaataaataagtagaggccaggcgcggtggctcacgcctgtaatctcaacactttgggaggccgagtgggggtggatcacttgacgtcagtagtttgagaccagcctggccaacgtggtgaaaccctgtctctgctaaaaatacaaaattagccgggcatggtggtgcaggcctgtagtcccagctaatcgggaggcggaggcaggagaatcacctgaacctgggaggtggaggttgcagtgagccaatagcgtgcattgcactccagcctgggcgacaagagcaaaactccatctcaaaaataaaataaaataaaataaaataaataaaataaaataaaataaaataaaatataaaaaattagctgggcacagtggtgcatacctgtagtcccagttactctggaggctgaggcaggagaatcgcttgaaccggggaggcagaggttgcactgagctgagatcgcactaaccattgcactccagcctgggtgacagagtgagtctctgaaaaaaaaaaagaaagaaagaaagaaaaaaagaagaaagaaagaaagaaagaagaaaagaaaggaaagaaagaagaaagaaagaaagaaaagaaaagaaggaaggaagcaaagaaagaaagaagaaagaaagaagaaaagaaaggaaagaaagaaaagaaagaaggaaaggaaggaaggaaagaaaagaaagaaggaaaagaaggaaggaaagaaagaagaaaggaaggaaagaaagaagaaagggaaagaaagaagagaaagaaaaaaacaaagaaagaagaaaagaaggaagaaaagaaagaaagaaaagaaaaggaaggaagcaaagaaagaagaaagaaaggaaagaaagaaagaaagaaaagaaggaaggaaggaaagaaaaagaagaaagaagaaagaagagaaagaagaaagaaaggaaaggacaaaagaaggaaggaaagaaagaaagagaaaaagaaagaaagaaaaaaaagactaactccaggttaggcgcggtggctcacacctgtcatcctggcactttgggaggccgaggcgggtggttcacgaggtcaggagatccagaccatcctggctaacatggtgaaccccacctgtactaaaaatacaaaaaaaattagctgggcgtggtggtgggcgcctgtagtcccactactcgggaggctgaggcaggagaatggtgtgaacccgggaggtggaagttgcggtgagccgagattgcaccactgcactccagcctgggcgacagagcgagactccgtctaaaaaaaaaaaaaagactaactccccaccactctccccaccctggcgaccatcatcctgtggtgtgtctctgagtctgacgacaccaggtccctcccaaaagtggaatcaggtactttctgtcctggcttctttcactaattatgatgtcctccaggttcatccatgtggtagcctgcgtaaggattcccttccttttcatggctgaataatattccattgtgtggataaagcagattgtgtttatctatgtattcatccatggacacttggccagctctcacctcttgggtgctgtgaattgcatcccttcaagctcctgctttcaactcctttgtgcctatacccagcagtggaactgctggaccctatgggaattctatgtttaatgttttgaggcaacctcgattttaagctgaaaaaggcaaacaaggacaaaatgaaactgtcactcactcctgtcagatcagcagatcaccccggtgaccacatcaagtgctgttgaggagctctgcccccaatctggcaagggatttggcaaattctactcgagttgaaatgcgaagctctcacacataggcaccaagaggcgtgcacaggagcgtgagactggggacgtgtgccatcggtcacgtccagccgggtggggaggctctgcacaatgtgcacgtagagaaacacaaggaggctgggagcagggcctcaggcctgtaatcccagcactgtggtaggccgaggtgggtgggtcagctgagttcaggggttcgagacgagcctggccaacatgctgaaacctcatctctactaaggatacaaaaattagccgggcatggtggtgcacgcctgtaatcccagctactcaggaggcagaggcaggagaatcacttgaacctgggaggaggaggttgcggtgagccgagattgtgccgctgcactccagcctgggtgacagagcaagactccatctcaaaaacaaaacaaaacaaaacaaaacaacaacaacacaacaaaaaacccacacacaagggcgagggcagccacacactactgtgcatgggccacatgcaggagaggcatgggaggggcacagaatcttccaaagaaacagacctgagctggccgagatggtggcggcacacacaagctagcccaggccccagtggaggtcaagtggggccgagaagaggcaagagcaaaaccagaagtcagcggttccaaagagaaacagacagcaaagatcaaagtgaaaggccggcaatggaaggaaaggctagaaaaacagaaacaaatcacctattgggtatgaggcttactatttaatacctgggtgatgaaataatctgtacacaaaacccacacaacatgcaatttgtctatggaaccaacctgcacatgtacccccgaaactaaaataaaatttaaaataataataaaatagggcaggcgtggtggctcatgcctgtcatcccagctactcaggaggctgaggcaggagaatcgcttgaacatgggaggcggaggttgcagtgagctgagactgcgccattgcactccagcctgggcgacagagtgagactcagtctcaaaaaaaaaaaaaaagaaagaaagaaagaaagaaagaaagaaaagaaataataataaaataaaaacatgaaagctttgaaggacctggcgtgccaccacagcaatcaggctccagtgaccctaggaacaagatggccacgcgccgggccaaggcagtgccctccagtcacagggtcactgaacagagaagcagcccccaggaccaacgcagagagggttccataaacccgggtccccaaagatcccctttgaatgggaagaagcgctccccaatcacatgatgacccactggaggatacgaactggccagtggatatttacccggtatttctattcccggaggccttcggcgtgggagggaaatgcctcacccaccttcgttctcccaggctgcaatgaggcaccttgcccaagcgtgctggcatttccctccctcaccaagtgcactacttcactatagttacgtaaaccgtcatgtcagcaatgtgacagccgcattgttttctttataaacataatttttaactatctaataattttataatgaaaatgttataataaaaacatctgaagcagctacaggcgatgctgagatttaacaaagttagctgaggtacagacaagtgttacctagacactcagaaaactgctttaaggaagaccaaccccgaaagctacgaagaaaaagacagacatgcatgaccacataaatcttcagaagacaaacaataggctgggtgtagtggttcacacctgtaatcccaacactttgggatgccaaggtgggaggattgctttagcccaggagtccgaggacaaaatgaggaggttgggtacagtggcttatgcctgtcatcccagcactttgagggcaaggcaggagtgtggtcctgggcaacacagagagaccccatctctagaaaaaaaatgtaagaattaggctgggctctggccaggcgcggtggctcatgcctataatcccagcactttgggaggccgaggcgggtggatcatgaggtcagttcgagaccagcctggccagcatggtgaaaccccatctctactaaaaatacaaaaaaattagccgggctaattttagctgtaatcccagctacttgggaagctgaggcaggagaattgcttgaacctgggaggcggaagttgcagtgagccaagatcgcgccattgcactccagcctgggcgacagagcgagactccgtctcaaaaaaaaaaaaaaaaaatttgtaacttaataacaaataatacatttcatagtaattttaaaaaaaaattttcttttttttttttttttttttaagaattagccagggaggctgggtgcagtggctcacacctgtaatcccagcactttaggaggccgaggtgagatcacctgaggtcgggagtttaagaccagcctgaccaacatggagaaaccccgtatctgctacaaatacagaaattagtcagacatggtggcgcatgcctgttatcccagctactcgggaggctgacacaggagaatcgcttgaacccaggaggcagaggttgcagtgagccaagattgcgccattgcgctccagcctgggcaacaagagcaaaactccatctcaaaaaaacaaaaacaaaaacaaaacaaaagaattagccagggatggtggcctgcgcccatagtcccagttacttgggaggctgaggtgggacgatctcttgagcctgggagttgaaggctgcagtgaaccatgattgcgccactgcactccagcctgggggacacagggagaccctgtctcaaaaatgcacacacactacttttggcggggggtcggtgagagaggggaaggggtctgagttagtcacaatgaaatctcatgtcaccctcatcagattggcacaccatgaaaatgcacccaccctgacatttgctggtggggggcggagaagcctctcacattgctgctagagatgtgaatcaagaacgtcactgggaaaagcactccagggatttgaaactgaagttcccttcagccctacaatcccactcctgagacctaactggagaagggcctgctccgggccagtgtgtgcagtttctagcagaccttggcacgtcaccaagccaaaatggggcccagaaaagcgaatgcatgatagtgtgtgccctatgctgtaatttttttgtttttttgagatggggtcttgctctgtcacccaggctggagtgcagtgatgccatcttattacaactgtgtcactgcagcctggatctcctgggttcaagtgatcctccccacctcagcctcctgagtagctgagactacaaatacacaccatcaagcccagctaattttttttatttttggtagagatggggtctccctacgttgtccagggtggtcttaaactcctgaggtcaagcaattcttccttctcagcctcccaaagtgctgggattgcaggcatcagccactgcgcctggcctaaaactatttttgttgttgtttttgagatggagtctcactctgttgcccaggctggggtgcaatggcacgatctcagctcactgcaacctccacctcccggatttaagcgattctcctgcctcagcctcccaagtagctgggattacaggctcccaccaccatgcccagctaatttttgtatttttagtagagatggggttttgtcatgttcgccaggctggtcttgaactcatgacttcaggtgatccacccgcctcagcctcccaaagtgctgggattacaggcgtgagccactgcaccgggcttaaaactatttttgtgtgtgtgtgtgtttgtttgtttttgagacagagtttcgctcttgttgcccaggctggagtgcagtggcgtgatctcggctcactgcaacctctgcctcccaggttcaagcgattctcctgcctcagcctcccgagtagctgggattataggcacccaccaccatgcctggttaattttttgtatttttagtagagacagggtttcactatattggccaggctgctctcggactcctgacctcagataatccacccgccttggcctcccaaagtgctgggattacaggcgtgagccagagcgccaggccctaaaactattttatgtggggagaaaatacccaggccatggcagcagaaagcaaggaagaagccacgtggaagccctcctggcgcttcttccagggaggtgagcagagagcacctggggccaggaggcggcatgcctgggtttctgctcctcctcactgtaactttcagccaagtcaaactgctagagtttcagtttctttatctgtgaaatgccggggctggcacagatggtttctaagatccctcccaggcctggaacctctaaaccgttaggtcaaaggtcggggagaggccccatctggcaaccattggctccccagctgtgctggggacgcagtggagcagcgagactgagaccaagaccagtaacggcaacggcggccctgacagccaatccccctgggcgaggccgagctcctccgtggactgcagagctggagggaggcacagccgccagcctccttcctccagtggctcaggggttggtggaatccgcaaaccccgggccagggctgaggcactctgaggtcccggccccagaaggggggttcgcctgggcaggaagggatgcaggaagctgtgtgactaatggcaactggccatacttggagaaacactaatttcaaaaagggcctggggagtgcaggttccaggccggggcctgcctggagccttctttgccacctgctctgccttgcgcaggttccggggcttctggctctgcttgtgttggctcaggacgtggttgttggatttagcaaataacaatcagaacacccagtgaaatctgaatttcaggtaaacaatacttttttagtaggagaaatgtctcatgcaacatttgagacacgcttgtgcaaaaccattgttcatcgcctggcgtataatctggcaactctggcaggagagggagggagcggagccaggcttcctgcagtccctgcccctctggaggtgtcccctccacataagcctctcctttgggtggggtccactcttccaggtgtcccacaaaaccgccctgaatcaccccaatctaggcacaccacctgtttcccgtgggaccccgcctgacccaggaggctcgcagggctgtttattacacaggtattggtaggaagaaaaagtaaaatcgtgatgagtgcttgttgctgcgaggtgtggcatgaagtcccagcagtcctctgtcaatgagggaaacagctactcacagagaaatcacaaaaggggatcccccactgctggatgaagagcctgcccccaccctgtctctgagcccgcatggaagcccgccttcttttcgccctccctccagcctctgtgaagtaagggtggcctctctggtgatgtgtgcagcctcttccctcttctagggcacatggtgctttcgagacgacctcaaatggaaccaggctgtttcccaagcaggtgctgtccttgctctcccctgccaaccacgtgccccacccccaggccccaagccctgggtcgggtcctgccatttgccccaggtccttacctggtggcaatgtgctcagccagccaggacagaacatccagcccaggtgcccagttccagaaacatctcagtcatcacagtcgtgggccgaatgccaacctcgagggcactgagcaggtgcacatgggtggcccatgctgagatgccatttggcagggacagggcatcctctctcctctgccctcacctttggagctggtcacttctccatttaatttgtgggcttaaagcagaccctccttagtacttaaggctccagggacaagactatggagtctgggatgaagagcccctgagttaaatgacattacctgtcttcaggagtcccctttacaggccgggcgcgggagctcatgcctgtaatcccagcactgggaggccgaagcgggcggatcacctgaggtcaggagttagagactagcctggccaacatgatgaaaccccgtctctactaaaaatacaaaaattagccgggcgtggtggtgggtgcctgtaatcccagctactcaggcagctgaggcaggagaatcgcttgaacccgggaggcagaggttgcagtgagccaagatcacaccattgcactccagcctgggcaacagagcaagactctgtctcgaaaaaaggaagtcccctttacagaccagatgccttcagatgaaaggaggtgaggcaggcctctaagtaacatagtgaccggcaggaaggactgtcccgggagtagagagggtggcacggagtcctcagtgcctctctggctgcggctaagaatgacccagcatcctgaccacaaactagagagtctgggccttgggctcgagggctcaaaaactgttgcctgcatgagaagcacgtgccgcctccagcacagtgcctgacgatactgtcagcagactggttcgcaaggacctgggtgacgggcaggtggggactgctcagactgtagccactaagggcatctaagccacaccctggctctgaggggagacccacaaagcaactttctgttgagagttcaacttttgacatttgtgtgtttcctcatctggatgcacactgcctggttccacagacgatctgaggtgatgtggctctcacgtgacctgcctacagttaacagtcacagatgtcatggggataattgagtgatttccccatcagtctgctgggcacgtatttagtgtgactcagtctccctgaatccagccgcctctaaggacactcactggtaccccactgactggcctgcctcactgctgccagtccacacccagagctgacaccccaaagatactccagacgatcgctctctgtccaaccatgagcatgaggggcttcttggtgtcatttccactccccttgccaatatttatttggaaacatttcaaactacagaaaagttatgcaaattacatcaggaacacacacatcccctgtgcggagatctgtgctttatgtctttgaaagtaagttgtcgagatcacagcactccacccctccacaccgaagcccgcagcttctcaggaaagggcagtcttgtgtgatcagtgcatatcatcacacacaggatgtctgacactggcaccacgctgccatctcagagtccatttcaatgctgggggtcatcggttttcagcaggttcttccctgggttcaacgcgtcttcccgccagagggatggaatcttgggtgagtgttgaaatgcgtcagaaacaaaaacgcaaagtggaactggagcacgtcacagaccttggaccagaagtggcctgtgaggcactggaagagacgccaccgtgcgagctgatggtcacacagcttgaggaccacaaagcccaggcaagagagcacccccaaagctaagtaggtagccgaggtggtgctgccatagtgcctgtgggtgcgcagcgcctgccccacagcggccaccacgtgagcacccagtgcgacctcgaagccctggggatgcagcagagcgaggccataactggccagggagacgcactcaagagagaggaacagccagggccgccagccgcggtctaggtagaggcaccaggccacgggccatgcaaagatgggcagtgtgagccactggtccagcaccgcggcacggcgccactgcgtccacaggcgcagccactgcacggggccatagagcagggccatggctgcgaacacgtccttcaggtagcggggacccagccccatcgcgccgcccctgtgcagccacgacagccccagcagcgtgtaggccatgttcacgagtgagttgaacggcatggccaggaaggcagggaggccggccacgggcgcctcggcgtagtgctcatagcccacttgcacggaaacactgtcgaaaatgcccgtgaacacagccacggcacagaggccaccggccacggccacgtgcacgaaggcctgcccccactctggattcatctggaaccggcggcgtgacctggggcagggagcttcagagagcagccttcaatacgcagcctctgcagaacactctgggcctcccggctgagccagcagaaagaagccccgtgatttcgtgatttccgaggcagatgctgcgaccttgccccgaaggaaggcaggagtcctgctgattggctggcgccagcggaggaacgttctgcctttttcctttgtggttacaaaaggagtgtggttagaaaacaaaccgtccccagcaccgcctccatgttcctgacccccggcctcaggagctaccaaccatcttcactggagaagcaaatcagagtgaaaccgctgcacactgactctctcaagcctctagaatcctctatcacccctttctcctggcacctaggaaaatcctgcccatcgtcctagtttccttaaagccactgcatctacagacaagacctgtctagctctgtcattacaactcagaatgcgccttcccatgtcagtgtgttataaaagtggacgtctccagccccaaagcccttttcaccaaatacccagctgaactagagaccattagatggagtccgagctctggcctctgacacaaggtgggggatggaggaggaggaggattcaccgtctgccactcaagcaccaggccgggaggcaagggggtgacccgcaggcttcccaggccagcttccctggctcactcgcctgccctctcctgaagtgccaagccccaaatcaccttctttcctcaggccaccataaagccttctgtctccttcagtcacagaaccagagagacaatttaattaccactgactgtcaactgctttggggccactggtgctgtaagtgagccctagtagctgagaaatacattaatatggaagggagaagagctttaatgctctgaaaatgactccaatcattaaagctcttctcccttccatattaataaatttcgcactcaagagggtgggcgggtaggcgggctcagggagagagaagggtgggctccagttcctggtcagctgatgccagactgttcaaaccttggctctcccacttactaaccatgtgatcttgcaccttaactgtcttgggcctcggtttgtgcacctttttttttttttttgagacggagtctcactctgttgcccaggctagagtgcagtggcacaatcttggctcactgcaacctccgcctcccaggttcaggtgattctcctgcctcagcctccctagtagcggtgattagaggcgtgtaccaccatgcccggctaacttttctatttttagtagagttggggtttcaccacgttggccaggctggtcttgaactcctgacctcaagtgatccacccgcctcagcctcccaaagtgctgggattcacaggtatgagccactgtgcccagcccggttagctcacctttgacctaatcgcttagaagttccaggcctgggagggatcttagaaaccatctgtgccagccccggcatttcacagataaagaaactgaaactctagcagtttgacttggctgaaagttacagtgaggaggagcagaaacccaggcatgccgcctcctggccccaggtgctctctgctcacctccctggaagaagcgccaggagggcttccacgtggcttcttccttgctttctgctgccatggcctgggtatttttatttagacacgggggtcttgctctgttgcccaggctggggtgcagtggcacaatcacagctcactgcagcctccacctcctgggcccaagctatcctcctgcctcagcctcccaagtagttgggaccagggatataccaccaccttgccctgctaatttttttttttttttttgagacggagtcttgctctgttgcccaggctggagtgcagtggtgcgatcttggctcactgcaagctccatctcccgggttcacgccattctcctacctcagcctccctaccacagcgcccggcctgccctgctaatttttgttaaaaaaattttgggccaggcatggtggctcatgcctgtaatcccagcactttgggaggccaaggcgggtggatcacgaggtcaggagatcgagagcatcctggctaacacggtgaaaccccgtctctactaaaacaatacaaaaaatagccaggcgtggtggtgggcgcctgttgtcccagctactcgggaggctgaggcaggagaatggcgtgaaccctggaggcggagcttgcagtgagctgagatcgcgccactgcactccaacctgggcgacagagcgcgactccatctaaaaaaaaaaaaaaaaaaaaattgtagagacagggtctcaccatgttgcccagcctggtctcgaactcttggcctcaagtgatcctcctgccttggcctcccaaagtcctgagattacaggagtgagccactgcacccagctaaacccctcttaagttgaaagtccagttcctatattttcgacttatgatgggtttatctggacattaccctgttatacatcaaaaagcatatgtagctgggcatggtggctcacatctgtaatcccagcaatttggaaggccaaggtgagaggactgcttgagtccaggagtttgagaccagcctgggcaacaaagtgagaccctgtctctacacaaaatacataaaattaaatttaaaaaataaaataaaaattagccaggcatggtggtgcacctatagtcccagctcctcaggaggctgaggcaggaagatcacttgagcccaggagatggaggctgcagtgagctatgggccacagagcaagaccctatctctaaaaaaaaaaaagctaggcgcagtggctcacacctataatcctagcactttgggaggccgaggcaggtggatcatctgaggtcaggagtttgagaccagcctagccaatgtggtgaaaccccgtctctaccaaaaatacaaaaaaattaggccgggcacggtggctcacgcctataatcccaacactttgggaggcagaggcgggtggatcacttgaggtcaggagttccagaccagtctggccaacatggtgaaaccctgtctctacaaaaatacaaaaaaattaaccaggcgtggtggcgcacgcctgtaatcccagctacttgggaggctgagacgggagaattgcttgaacccaggaggcagaggttgcagtgagccaagatcgtgccattgcactccagcctgggcggcagagtgagacttcatctcagaaaaacaaaacaaaacaaaacaaaacaaaacaaaacaaaacaaaacaaaaaattagccaggtgtggtggcacatgcctataatcccagctactcgggaggctgaggcaggagaatcgcttgagcccgggaggcggaggttgcagtgagccgagatcacgccactgcactccagcctgggcaacaagagcgaaactccctctcccccccaaaaaaaaaaaaaaaaaaaaaaaaagtggccaggcgtggtggctcacgtctgtaatcccagcactctgggtggctgaggtgggtggatcagttgaggtcaagagttcaagaccaccctggccaatatggtgaaaccccatctctactaaaatacaaaaattagccaggcgtgatggctcatgcctgtagttccagctacttgggaggctgaggcaggagaatcgctcaaacctgggaggcggaggttgcagtgagccaagatcgtgccactgcactccagcctgggcgacagaatgagactccgtctcaaaaaaaaaaaaagtatctgtatatgcagaccacttagcactattttattattacttcattttattttgtttttttgagacagactcttgctctgtcgcccaggctggagtgcagtggcgtggtctcggctcagtacaacctctccctccggggtttgagtgattctcctgcctcagcctcctgagtagctgggattacaactaaaattagcccggctaatttttgtatttttagtagagacggggtttcaccatcttggtcaggctggtcttcaactcctgacctcgtgatctacctgcttcggcctcccaaagtgctgggattacaggcatgagccaccgtgcctggcctattttatttttttattgagacggaatcttgcactgtctgcactgttgtccaggctggagtggtgtgatcttgcctcactgcaacctctgcctcccgttttcaagagattctcctgcctcagcctcctgagtagctgggattacaggcgcccgccaccatgcacagctaattttttgtattttttttagtagagacagggtttcaccatgttggccaggctggtctccaactcctgacctcaagtgatccgcccgcctcggcctcccaaagtgctgggatgacaggcgtgagccaccacacctggcctattttatttattttttgggacagagtctcgctctgtggggcaggctggggtacagtggcaggatctcggctcactgcaacctccgcctcccgggttcaagcgattctcctgcctcagcctcccgagtagctggaagtacaggcgggccatcacgcccggctaatttttgtattttagtagagatgggattttgccatatcggctggggtggtattgaactcctgacctcaactgatctgtccccctcagcctcccaaagtgccgggattacaggcgtgaaccactgtgcccagcctattttattatttttaatagcatatagagtgacattttgatacatgtatataatgtataatgatcaaacaaggtaattagcatatccatcacctggaacatttatcatttctttgtgttgggaacattccaaatcctttcttatagtcttttgaaaatacacaagaaattgtagttaacagtgctcaccctacagtgcagaacagcaggatccattcatgctatgaagctggcattttgtatttgttatccgactcctccgaatctttccctactctctaatctttccagcttctaatacccactatgcttctatttccatgagcttgattttttaaatattttacataagaattaacacatacaatatttatctttctgttcctggcttatttcacttaacataacgtcctctaggctcatccatgttgccacaaataacaagatttatcttattagtttgtttatttctttgagacagggtctcgttctgtctcccaggctgagtgcagtggtgtgattgcagctcactgcagcctccacctcccaggctcaagtggtcctctcacttcagcctcccaggtaaatgggaccacaggcatgttaccatgcctggcaaatttttaaattttttttgaaagacagggtcttgctatgttgcccagactggtctcaaactcctaggctcaagcgaccctctcaccttggcctcccaaagtgctgggattacaggcgtgagttactgcacccagccaatagttttttattttttttattttttatagttggttttggttttttttgagacagggtctcgctctgtcacccaggctggagtgcagtggcacaatctcggctcaccacagcctgcgtctcccaggttcaagcaattctcctgcctcagcctcccaagtagctgggattataggcgcctgccaccacacctggctaattcttgtatttttggtagagatggggtttcgccatgttggccaggctggtctcgaactcctgatctcaggtgatctggccgtcttggcctcccaaagtactgggattacaggcttgaaacaccgcgcccgccaacagtttatttttaaatggctcaataatattccatcatgtatctataccacattttctttacatatcaatccactggtggacacttagattgcttccatatcttagctattataagtagtacaaaggcacgaagaacctacattggggaaaggatggtctcttcaataaatggcactgggaaaattggataagtatgtgaagaagaatgaaaactaggcccctatctctcaccacacacagtaatcaactcaacatggattaaagacttaaaagtaagacctgaaactataaagctactagaagaggccagcgcggtggctcacacctgtaatcccagcacactgggaggttgaggcgggcagatcacttaaggtcaggagttctagaccagcctggccaacacagtgcaaccccgtctctactaaaaatacaaaaagtagccgggcgtggtggcgcacatctgtaatcccagttactcagggggctggggcaggagaaatgcttgaacccaagaggaggaggttgcagtgagccaagatcacaccactgcactccagcctggggcgacagagcaagactctgtctttaaaaaaaaaaaaaaaaaaaaaaaaaaaaaaaggctgggtgtggtggctcacacctgtaatcccagcacactgggaggctgaggcgggcagatcacctgaggtcaggagttccagcccagcctgtccaacatggtgaaaccccatctctactaaaagtataaaaattagccagggtggtggcatgcgcctgtaatcccagctacttgtgagggtgtggcaggagaatcgcttgatcccaggaggctaaggttgcagtgagccaagattgtgccactgcactccagcctgggtttcagagtgagactgtgtctcaaaaaataaataaataaataaatacaaataataaaataaataaaataaaactactagaagaaaatggggaaatgctccaggaaagattttatggctaagaccccaaaatcacaggcaacaaaaacaaaaacagacaaatgggagtatattaaagtaaaaagcttttgcacagcacagaagcaatcaacaatgaagagacaatataggagaaaatatttgcaaatgattcatgtgacaagcactgtttatttttgaggtgcaatgtccatctgccctactgcaatttaggccccaaatgggtgggacagggtctgattccttgctcttcctcagatgcccagtgaagccctgctcaatttcaattcaattatattaaagaacaaagccagcacctctgctcccttttaccagtcctgtttgctatttcacttctcaagcaggtcctggggcccaccgcatcctcctgggcctcattctcagccttcttgccttggagttccgttgctgaggagggccaccaggcttggcatgtgggtgccccattgccctctgaagcatggtgttgccacacaggaaccacagtcctcactatcactccatacgtccttgcttcacacaagcctgccatctcagcatggggcacccgaactcctcctgccccgtcctcccagtcaaaaaagcctctgggtccaggggtgtgcacaccgcagccccagcatctttgagcagccctggatgggatcatgtctgccctggctttccacccttccatgaccagcttcccattccatgtcctggatcatgtcccaaagtcttggccagacttaaagtgccatccccatccagccctgtgagctcctcaggcccagctctgtcctggaagccctttgcccacttcgcctggccattgcccttgactcagctgtcatttcctctcaggcacttccccgttcagctcctgactccagctgagacaccagctgaggccccgcatggcgtctacaggtccttccctgcacccacctagggccccatggcacccatgctagtctgaccctcctgcctgccagcaagcagggcggagagctggaacaagagtcaaacactgtcaacttgatcgaggaagaactccaggaagggcatggaaagcaactcctctttccggctgcaggggttcagtctatctgaccgggggtacgggctgacagtgaccatgtaatcaaagcacctgtccaagacccccaggaaaaccgagctggttaccttatagcctagcttccctgtacctttgaattgccatgatccttattatgtgacactcaaatctcgtcacagcttcccccagcgcctggcatgggaaagccaacacctcaacagcactggcccctgggtctggggtctttcagggaagccctgggaagcctgacaatctcctggctaaaggccccagactctcccgcacgcgtttaaacagcaggcactgtcacctccaggcctttagcatttatggttagttatgtcccccgctccgcatgacctttcttgctgtctttctgtggataaaggaatatcaattaacattaatttagcttctggactgattccaggcaaggcccttggaaaccagcagctgcttttgtgtgtgtgtgtgtgtgtgtgtgtgtttttgagacagggtcttgctctgtcgcccaggctggagcagtggcgcgatctcagctcactgcagccctgaactccctggctcaagccatcctcccacctcagcgttccaagtacctgggaccacaggcgtgtgccaccatgcctccgggtctcgctatgttgccccggctaggctcaagcaatcctcccacctcagccttccaaagtgttgggattacaggcatgagccaacgcatcaggccttagttttcttatttaccatgggtgggggacttggggacatatgtgaggtaactagccaaggtcacaaagagcaggtggtggcacagacaggcaagaattcttctctttgtcccttctcaaatggatacttccaactgcatgaactaaaacacagacgattacaaaatacatgtaatatgttgagaggcgactttaaaaatattgttgaaaatgtgtgagagggtgacgtgtgcttctttactaacgcattaaattacaaggtcttccagcaggacgcataacttcagtaacttcaaagtaataattctgcccgccggtagatctggtagatcttgtaatttaactgaacttctagacgtttacaacaaaagccacaggctctgacaggaccggtctgtccatttctactggcgactgccgctcccgggcagcagcttgggtccccgcgctgcggcctgcgcgtggcagggcggatgccgccgccgccgccgccgccgccgcgcccgggcggcctcctagaggaggcgaaacgtgggggcgaggccgggacccacctcccagggctgcggtgagcacttacagtattggcgcgaaaaggccagctatcaccatacgggtatttcgcctcactcgcctcgctgggggaaattcaaatctccgaaaagggaggatccgagcagcgccggtgcgcctgcgcgcagggcgggactcgaagcctgggaagcgggcggggcgaggtgacgcgagatgacgcggacgcctcccgcggtcgcccgcccggctcgtgcgccaccggcccgactgcgggcctctcggcagtgggggcggccgagcgcgcggcggtctggggcgcgcggcccggctcattttgctgcggcgcgggcggaggcggtggcgcccgagggcgggccccgcagcctgggagcctgggagcgggcggaggctccacccccgggcgccggcgctcggctgcgtcgcctcccactgtcgccccgcccccggctcccccgcggcgcgcctcgggccgcctcctgcggctgctgggtgtgcagggcgcgaaaatgctcgcttcccggccgcaggcgcggctgcagtggctgttcgccaaccccggccacctgcgtgccgctgtccccagtgctggttaaaggcagttcttcgggcgtgcgtcccttatcaacccgagagaccgttcccaagggggcggggccgagcgcgtcggaggggttagcagtctcatccgggcatttccgagatgccgccgccgccatctttgttttgtgctgaaagtcgctattgacgcccgcggacggccgggcgaggggaagtggcaagatggcggctcccagggcggaggcgtggaggctcgcccggtgggggggccgtggggcggggcgcgcctgcgcctgcacctgatctgagcgcgactcgagctttagcccagcgcgcggcagcgccgacccccacccccgccgcgaggcagcgcaggggtcctttaagaggcttgggcccaggggcgaagcggtgcgagggcgagtggggggaagcggtgacgtcacccggctccgcctcctcgcccgaccgccggcgccgctgccgccatgtttagttgttacttcttcacacaagatggcggctcccagggaggaggcatgagcgccctgccgttaccgcttcttctgccgtacagttgccgcttcggggcctaactctagctctttgaagcggctcctgtgggaaggagtcataaggcgggaagtgaggatcggacaccgccttgagtttggtgtgcagtggaagaactgacctaggaggaagagaataggggggaacggggagctagtctcaagatggcggctcccacggcggcaggcgcagcctgagcagcagaggcggactaaggggagaggcgcgagacttcacaagccgtacggcgcgagcccccaaacggccctcgagagctcgagctggttccaccggcctccggcccgcctccattcgttaggtgtgtcgaggctgtttcgggagcggcggctgcactaaggcgctgggcggggaagcgggacggtctcaagatggcggctcccacaattgtggtctgagcgccggcggggctgcgacgaccgcggcgcttgtggctcctttccacccgccccggaagccggccagtgctggggacttgggggtgtgggaaccgggccggggctccgccatttccggcgggggagggctacgactgaggaagggaggagagagaggcggctcaagatggcggctcccagggcctcccgcccgagcttgtaagcgggagcgcccggacaagtagtcggggcgacgggactcagcggcctccagcttcttgagcctaggcgctcgacagtttcgggcggctcttgcggagacggggtgagcgagaagaaagggaagagccaaagggaaggagggcagttaagatggcggcctccatggagtcgtctaccgctgtgtgagaaaccgcttctccgtgagagctgccttagacgaaagggggtgtgtgaaaggaattgaggggctcccttcccgcttgttgacttctccccaccgcaccctttcccggaactatggcttcggccgtgtcgcccgccaacttgccagcggtgcttctgcagccccgctggaagcgagtggtgggctggtcgggtccggtgccacggccccgccacggccaccgcgccgtggccatcaaggagctcatcgtggtgtttggcggcggcaacgagggaatagtggacgaactgcacgtgtacaacacgggtgagtgcaaagcccgctgggtcttcggctctttccctccctccatctcctccctctccctcctctttcctccctccctccatctgctccctccctctcctccctccctccatctcctccctcaccctctacccttccctctctctctcccctcctcccttacccgtccttctcccctctccccgtccccctcccccttctcccctcctccccctccctccccactgatcggcttgcccctcccctttgctgtgccgggcttcagtgcttttctctgatcttctccccgttcccttgtctctcccgtgtttgaggattggttttcgttagttaaaagaaagcccctagtccgactggtgagggagaggggctgtcgccagcggtggtgacttcagacccacaccgttacccagcgggctggggctggggctggggcgggcggatgtgtccccttggcgcaggcagagctcccctccctccctccctcccttctcctgcgcctgctcagctctccctcatctcgagtgcccattctggagaaatgaccatttctagattacagattcgttctctgtctctcgaaaaagggagggaagggaagcgctcttaggacgcagagtttaacatccgccgacccgggtaatgccggagccttggggacccctaggacgggccggcggcagggccgcctctccctttccacgtttacttctgcagcatttctttccaagtcgccccttctcctaatctggtgccttctggtttacaagctgaattccagttacccctcagcggcctgcgtagtcgtgtgtctccccgcttctgcggatccagggggttaccccacccgctcttctgcctccctgcaaaacccaaagcccgttagttgggaaggggaggaacctctctcttcaggtatggctgatgcaccacggccttcgtgggggccgtttgttgttgcctctgcctagtagccttgcttagtctctagggcagaaagcctgctgctgtccacgacagctttgtggcatcctttttcttggtggctacttggcccgttttgtgcccctagcacaagggtcagttcccaagttgcctactgactgcccgttggcccacaggaccctggccttgcccagaaggcagggtcagggtgagttcggtcccaggcaagagctggaagagtctgggtgagggaaaagccccctgcaggcggctgggggagggccttgggatgccctagtcctgagtggcaggcacggctcccagcactaaccccttgctccgcggccgttctctcctgggggctctagcgatcccctggcctcggtggtggccctgcagacaaaccctcgctgagtgggctttgtgtcctgagcggtgagaggctgctgttctttggctgagctccagtgcctcgatgctctgggggtgggaagctggagctgcctggagggagaaagttggtttagggagttgggaaggctggagctgggctcttgggtgccgcttccttccccaccccccaaggcagaaagtgctggtttctccacatctcggagattatcgccacctaccacgttgactttgaaaggctggtgggttgtctgtgaccgtttttcgttccaggtctctcagcacctgttgcctccagggagcagggcctttctcagcagcccccgggcgggggcgcttggtggttggtggtgccccgcgccagcccaggcagctgcagtagcaggaattagctcagtaagctaaggcttctccagtggtggggctgtttatagaggcaccgtcaccatgagcagcaccttctccactctgtggaccgactttcttctcataaggcctggagcaggctccctggcagggaaatgcaattttagaaagtagggcaggggcctaattacagtcggctccagagtccaccaccactgctgccttggcttcctggggcctctgcatattcattagtttattaaaatgaattgaccactttggcatgaattcattaccagtctgcaaagacaggttgtgcattagaggggtagcctgccttccaaagggctgcttaaaatgaagctctgggatcctccagggtagcagtttggaaactgtcatcggcaattcctcagacgagagagcagctggcagacctgaagccctcttcctcaccggggtttctgccccctcccgccagcccggcctcgtcacctttgtcttgtcttcttttgttgtgtttgggatgagatcagggcatattctcacgcctgtgccccttgcagttctgcgggatcagtcctcaaaaagccttgtacctttggagagagctgatctggaaggggttcccgttgctaggataagaaagcttcagggggtgtgtgctttgagagctcttagggtagctactgtgcttgtccttagggaattttagttccatgtggcaagccaaaggattcagagtgctgccaggtgtggggggtgggggagcgagagctttggctacggtggctctgtaatgtccataggttcttggagctggagggagccttggaaaatacctagtggaactacttccttgtttctgcagatgaggaaattggggtccaagaggggaagtgacaggtccagggtcgccctcccagctggtggcggagttgggcgggagtgcaaaccttcatagaggccgttctgccacctgtctttggggcccatcacctttgaaatgcctccattctctcctctgtccctgtatctaattgttcattgcgttgggcaggcatcaaatgtgtccccttccacaccaagccctcctctcctcttactagactcttgcagtcacttcctgattggccctgctagtttcatttgtcgggaaatcctgttcacccttcaaggcccggctgaaacgtcacctcttctgagaagccctttccactcctgtcctcccctctccagcagtcgcactgctctgtgctcccaagggcccggcttggtcagagctcttctagggtgtttgtctcatcgtgggaggggggcatgcagccttcctaccccattgggagtatgagcacaagatcggtgtcctctgtgcctcccagcacgtcgtatgccacacaggaaatgctctaatgtgacaggtagaacagagaggaaggcagctcgttgaacttgaccggccacctcactgcatgggcaccagtctctaggtggtgatgggacagtggcaaccagggatggagcttgcagagcatgaagtggttgggggagctgatgaaacacagagaggccggggcacagccttgctcaggagaggggagctggagtggtcttcatctagtgcagggtcctttccccaccttcccctcccagctgagagccagcatttccaggatgaggggcccaaggattgggttacatgacaccccccagatgattcaggggtgactgagagcagctgtcacattgaaaagctgggagaagggaggagagcttgctcgtgtgctttcagggggcggaaccaggactcgtgggtgagatgaggagccgcaggtttgtcgtcacaccaggagctgtgctccctgacagacctctcttgacgggggtggggagggcccctgccctgcctggagtgttctagaatgagatcagcacctcttgggtcctgtagaaggatctggtgagcgggatccccaaagatatcacagggcgcttctggcctggcccaccggctcactgatcagcgtgtgataggaaagctgcccactgaccccacgtgccatttagctttgtcccaaactctgacccgcagccccatagctgtgggctttgaccacgagggtgctcaggggagtgagggtggctgcctggacatgggaccctagggaaggcacagatcggttgcttcaagtcagtgatggggctgttgtctctgtctctgttttacgctgtgacctcaggtgtcgcttgccctcctgggctctgcccctttacctaccgagagcagttggcccaggcagccttaggtctcgttatgcgtttaccctggtagcttgcatggagctccctccagggattggtcaggacggctctccagtgcgcaaggctgttggccttggcagctcttgcttttctggggtggtttttgcactgggaatgagaaagaggcagagggccaggatccgagcttgcacatgcgggcggcacaggtgttgtccctctgctttagggaaatggcaggggagctctagtgctcggcatgtccgaggcccagtgactcagctgaatggctgcagaggctgtcagcctgctcgaagcctacccgcagagtgggtgctggagagcggggtgggggtgctctcgcctcaggaggagcggtggtggtacagttgtgctgtgtggggttttctgttttttttgtttgtttgtttgttttgaggttaggtcttgctctgttgcccaggccgggatgcagtggtgcggtctcagctcactgcagcctcaaactctgagggtcaggcagtcctcccgcctcagcctcctgagtagctaggaccacaagtgtatgccaccacactgagccagtgttttaaaattatttgtagagacggggtctccctgtgctacccaggctgggagttgtgctttggataagggctagccttgcacacggttccgcattgagccctgggggtgacagtgtgagactgggtgggaccagagtgcagtggggcatgcattcccaaccatggtcagccgcctggccctgggtgcacacctgaatatggaaaaaaaacactgtttttcctcttctatggtctcacaacacttttggccaccaaactgaatagtctgtattatatcacaatatcacagcatccctgtgtggaagccttcccaccccacaggaatccccccatgccctgtcacgtcctgggggacccatcttgcgtcttgagtcatgtggaggggcctcagttccttctgccgtctgcttgctgagatctcacccaggccagctcagaggcacagagtcggggttgcacctggcccccagtttggggtttctggaaagagtgtggtgaatcctctgagggacccctcataggaggaggttttcggggaagccctggcctgccaggtgtgaggggagtcaagtttgaggacatgagggaggggcctggtcccagctgaaggctgctgtgccatcctgtggaagcaaagcagtgcctaaggtctgatttccctctttcttggtggtcgcctcaccctcatgagcttttgagaagcttctgtcacagctctgctgagactgctgcctctggcttgcaagaatgttctggagtaccataggtgtggcagcaggggcagggagggatgctggtggaccatcacctaggagaccagaggaagtccgggaggtcagagcagaggccgggtctcatccccatggctcttcgtagcctgcagcggtcactgttttggccacttgaaagtgctgctctgggctctggctgtcctgaccctgtgatgaagggacaaaaatgtgggctccagggaggaggagcacaggcccaccaagagggtattttggggagaaattcatgtctgatcactgagtgctagggaaggaaggcagtggctagattcccagtagctgatgagggatcttgcacagtaacttcccgctcattaagatgaccttggcgagaagcagggtggtcacaggctcttttgcactggcctgaagtcgaggggtttggaagatggcccaggtagcgcagctggagttgctagagcgcccgcagggatggtgctggctcagcccctctcaccaagcttgacggctggcacatttggggaatgagaggaatgggggctcccgggtgttctgacttctgcctccttctgttccccagcaaccaaccagtggttcatcccagccgtgaggggggacattccccctgggtgtgcagcctatggcttcgtgtgtgacgggactcgcctcctggtgtttggtgggatggtggagtatgggaaatacagcaatgacctctacgaactccaggtaaagcagccccaggttctcactctgcctccttggccccatgtgacctgacggtagtggcttcagggttgaggcaagcgggaggtggaagggacgcttgagagtctgccaaggctgctctgaacttggcccacctcagaagaaggcagcaaggaccaacacccaggaccttcttgctccagcaaggcacctcgctcacccccggccatttcctcctccaccacaagttgccccgggtccctagtggtggccttctcatcccacggttcagtctccaggtcttgattttgcaggcgagccggtgggagtggaagagactcaaagcaaagacgcccaaaaacgggccccctccgtgtcctcgactcgggcacagcttctcccttgtgggcaacaaatgctacctgtttgggggtctggccaatgatagcgaggacccaaagaacaacattccaaggtgaggcttggtccttttctctggaaccccccgggtgggtgtgctctcacatgcacagggctccatggtgtcctaaagaatgtgcgcagcagagccccgtggccgggtccctttctcgtgctgggttgtaaatgagagagcggcaccggatgccctctcaggagctttcgggctccaaaatcgctactgaccctgagcaggcctcgtgggaggagggccaagctggaggtggaagccactttgccttgggctggcccagctctcggagtcggcttagagctgctcgcgttccttctcagcctccgctgcctacaagtttcctgatgggtattttccaaggcccgtggccaaggactctctgtctggaggtagtcccaagccagcgccccctcttgctctgcggagccctcatataatacccagctttgtgtgcatggcgggggcctgctgctgggtctggactcggggctgctgtgcagcctcacccaccctgtgtcccctgttccagttggactcatcctagggagcttctggcagccccttcctcaagagctagggtagaagaacttcagagctcccacagccctagcccctttgtgttctggggaggctgccactcactgatagccatccagcgaagcctctggcgtgaggagtcgagacttgccgtaactgatctttcctcgtcaggtacctgaatgacttatatatcctggaattacggccaggctctggagtggtagcctgggacattcccatcacttacggggtcctaccaccaccccgggagtcacatactgccgtggtctacaccgaaaaagacaataagaagtccaagctggtgatctacggcgggatgagtggctgcaggctgggggacctgtggaccctagatattggtgagcagggtggtagcaccccagcagccatgggacaaagcgggtctgcctcttggctggccccgtgggtggcgctgttgtatggtgaggtggggctcttagggagctggagcataccacttcgtgctttcctcttgtcatggtgggccagggtggggaaccctggatcgtccctaggtttggggctgttatctctgccctgtgctggctgagtgggctgaattggtctgcgggcttataagagaataagtcattaaggctttctagaatggaattctctggatccgggtagcattagtccctcttgactcgtcagtggtcagactgtgtggagtgctgcatcctggtctgactgctgtggtaccattggatgccggtaaaccgtgaggccttcggggactgcttgggccggtcaccaggtggtggtatcaggagtggctgggaaagattactaactgtggatctccggaggcctcttcagctgggagagaggagatggcgatgttgtcctatagatcagagtcggcactccaaagaagcagtttcccgtgagagaattttccaacagtttgccaaaatgtctgtagcctaaggtggttatggcggtgaacgtatttcatggagagttcggggtgtgcccaccactcctcccccagcacagagtgcagtcctggctcagggcaggtgctcaggatgtacctgaaggagcgctattgctagcctggtcgaaaccgcctgggtaacacaggaatctagctaccatgacaacagtcagagggcctgccgtaggctatagggaagccagggatggaattctctcactgagacagatcctaccttcctgagctagcttgaatccagggaacgacctgtgtgcagtctaccttgtgtaaccctttcccctccgtctctctgcagacaccctgacgtggaataagcccagtctcagcggggtggcgcctcttcctcgcagtctccactcggcaaccaccatcggaaataagtaagtggctgctcacctgcgtctctcttctctagactggcgtggcccctcccccgaagggctctcactcagttttgtcctgtcagaccctaaggcctgaggatgcctctttctggctgggctggcatttggcagccctgtttttccattacgaccctgggggaccaaggaaagacagattcaggggggagagggccacacacaagctgagtctgagaccctccccgggcctgtgaggctccgccctatcaggtacagagtgttctaggtcctctgtgcaagcacctgggtgtctttgtggatgtccaggtcctaaagggaacctagaaactgtggacatgaaggtgagctttagatgagctgaacggcacttttatgtggtagaggtgacacagttctcctgagggctgagccaccaggcaggagagggccacgtcaggaggcttcacgcatccttggggactctcctggggagagccagaggactgagctctagaactggggtagcagaggtggcctctagcttggcaccaactctacaatcctttcccactcttccctcctcactcccagaatgtacgtgtttggtggctgggtgcctctcgtcatggatgacgtcaaagtggccacacacgagaaggagtggaagtgtaccaacacgctggcttgtctcaacctgggtatggcctcctcgggctccgagtggcctgtgggaggctgcaggaggctggcccttctcagcctaagagctgtgtggggtgtgcggggagcaagctgggcccccggctccctttggaatccactggaaggatccagtgggcagagctctctgaagcaatgttccgcctctgagttttttgaatgagctctccatccaaatggcccaacatccaaaagtgcaaaagcctctacggtgcagggcctccttccctcctcccggttctccggttctgcttctcagaggcagccatgtgggtggtttcctgtccaccctgcaggggctcttcatatctgagcattagccataggtccctttaaaaacaaacagtggcagcctggcgcacgcagtgccacacctggcctttctcatccgccgtatcttggagatcactccacgtccctgccccgcagcagcctccttcgagttgcggttgtgctgctgtaacttgtacaggcgccgctccgtgagtatccttgcaccatctccacccgtgtgcaagtgtatcctaggggtgaaaacctagaagtagggttgctgtccgatgcggctgaactgccctgcacagaggctgtgcccacgtaggcgcctccagtggtgccctcacggaatggtcaggccactctttgccaagcctgatgggtggccgaagctccccctccggctcaccttgagccccagctgctgcgggcctgaaaataaaaatgccaggcgccgatggttgaagtttagatttcttttgcgtgagagtgtgtgttttttcttaagatctttctatcacgttttccctaaaccactttcccattgccgtctctttctgtgagttgtagtgttctttaacgggcaaggaggtaaacctctgactgtgtttctcatggttttcttagttggccgttggtggtttgtaattttattttttgtgttgctttttgccacaaagggtttctttgttttgttgtttttaatgtaataatccaataacttcttgattttaattcccatccttgacaacaaaagaaccaagggcaaccaggggtggcgggtttcctccatcctccttgctgacctcccttgtctgccctcccccagataccatggcctgggagaccatcctgatggatacactggaggacaacatcccccgtgctcgggctggccactgcgcagtcgccatcaacacccgcctgtacatttggagtgggcgtgacggctaccgcaaggcctggaacaaccaggtctgctgcaaggacctctggtacctagagacaggtaggcccggcccagccgactcccctcctcccatagcctcccgccccttctcaccaactgcgttctcccacagaaaagccaccacccccagcccgagtacaactggtacgcgccaacaccaactccctggaggtgagctggggggcagtggcaacagccgacagctaccttctccagctccagaaatatgacattcctgccacggctgctactgccacctcccctacacccaatccggtcccatctgtgcctgccaaccctcccaagagccctgccccagcagcagccgcacctgctgtgcagccgctgacccaagtaggcatcacgctcctgccccaggctgcccccgcacccccgaccaccaccaccatccaggtcttgccaacggtgcctggcagctccatttctgtgcccaccgcagccaggactcaaggtgagccaggggaccagggacgtttgaaagtagggggctagcctccggggagaggcagcggccaagtaggggctgcgagacggcagcctagacagcaggccagcagccgggagctttgggcttgtctccaagggttgtagggggatgctaaagcctggccccacctgtggaaatggtcactctcagggcacagagaagagccagactcccacacaagcaggccaacagaagtggctcagggctgcctgcaaaggggctggggacatcgtgcagaaggtgatggctgacggctggccccttctctcatcaggtgtccctgctgttctcaaagtgaccggtcctcaggctacaacaggaactccattggtcaccatgcgacctgccagccaggctgggaaagcccctgtcaccgtgacctcccttcccgccggagtgcggatggttgtgccaacacagagtgcccagggaacggtgaggagtggtcactggggcgggtgggatttcctgttgatccagtggattaagttgcaagtgtactgaggggttcacatccctctcgggctctggtaccacgcaccccacacctttccctcctgggacgtgcagatggggaaacgctcctgcgaggtcatggtgggaattaataggttaatgcctagaaggcctaacctgctgcctgatcctaagagcatttgccacgtggactttcttgtcctgcagcctgagaggaggatctagccagctgggcttgccacaggcccatgagaatcaacgggacctgactctggtctttagaaaggatccagagctcccagctgcctcttgccacgggggttgccgtgcatggtgggtggtgggagccctctgtgtctggggccaggagagcggggtctggcagtagagaaagctgagccatgctggcgggatgaggctcccaagagcagggcagcccctgggcaggttccggtgaggtccaccaagcagggaggtgggtggcacctgtgacctggcctcacatgcccgtgcctgctgcaggtgattggcagtagcccacagatgagtgggatggccgcactggccgctgcggccgctgccacccagaagatccccccttcctcggcacccacggtgctgagtgtcccagcgggtaccaccatcgtgaagaccatggctgtgacacctggcactaccaccctcccagccactgtgaaggtggcctcctcgccagtcatggtgagcgtcttccggggcttgtcactgtggtcaaacaagcatagtcattccctccgggctttagagttagccgttggaccgtgggctgcagaataagctgtctccattaggggcgtcatggcctcaggtgagagctgcaggctcagcctcctcccttgcctgttaaaggaagggggaaccaagctgttcttgggcttgggagcaggaggaggaggaaggtgagtgttgaggcaggagctatgggcccaccgtggacatcttgggtggtttccccatcgctttctttgcctggcctgtcactcgtctctgcctcctccaggtgagcaaccctgccactcgcatgctgaagactgcagccgcccaggtggggacatcggtttcctccgccaccaacacgtctacccgccctatcatcacagtgcacaagtcaggcactgtgacagtggcccagcaagcccaggtggtgaccacagttgtgggcggggtcaccaagaccatcaccctggtgaagagccccatctctgtcccaggaggcagtgctctggtgagtgatgggtgctgccaggctacggccactgccagtggtgaatggccgccctgggccagctccaggagagtctcagccaggccatgcccttgtttggtttccagatcactccttgctccatcccttcctttttagatttccaatctgggcaaagtgatgtcggtggtccagaccaaaccagttcagacttcagcagtcacaggccaggcgtccacgggtcctgtgactcagatcatccaggtgagctctcagtctttgcacatacgcaagagtgggggcctgggtgccaggccacaggaagaactcatgtccctgcccatggaagatcccatgagcacacatggctcagcaagttctgctgctcactcccctcgcccacagcctccagaacattccctgagccgccaaggctgccggcggagagtagccagaccacacttcccttcctggcagtgatgccggctcatgcacctgcttccccctttcagaccaaagggcccctgccagcgggaacaatcctgaagctggtgacctcagcagatggcaagcccaccaccatcatcactaccacgcaggccagtggggcggggaccaagcccaccatcctgggcatcagcagcgtctcccccagtaccaccaagcccggcacgaccaccatcatcaaaaccatccccatgtcggccatcatcacccaggcgggcgccacgggtaggggcctcccccgacatatgagtgtctgcaagtcctcactggaggggaaatggagtccgggttataaggcgtgctgtgtttctgtttagtttacccttttctatcttctccttgctgccttttgtgtctaagggtagtgaggagatgggcagggctatggctgtgacttgtggatgttcattatagtctaggggcagcaggggcagccctcacagagcctgtctcccctgggccccactctcccatccaggtgtgaccagcagtcctggcatcaagtcccccatcaccatcatcaccaccaaggtgatgacttcaggaactggagcacctgcgaaaatcatcactgctgtccccaaaattgccactggccacgggcagcagggagtgacccaggtgaggcactcccagccgtctctcagcccagtgtcctagtgcagtccaccccagcacgccacgcaggtcctcccgacaggcctgggaggggcagcatcggtggcatctaccagcctggtggtgacgttggtggcactttcctctggtgttccaggtggtgcttaagggggccccgggacagccaggcaccatcctccgcactgtgcccatggggggtgttcgcctggtcacacccgtcaccgtctccgccgtcaagccagccgtcaccacgttggttgtgaaaggcaccacaggtgtgtacccataggccaggtcccctgccacccctagattataacgaagcagggctggccttcaatccccatggcacagctgggtggcacagcagctcctctctcccgagccttctatgcaagcagctccagagtgccccagcctgtgcaggaggagctgctgggaaggagacagcagcagccttggcccaactcttgcctcctttccttcaggtgtcacgaccctaggcacagtgacaggcaccgtctccaccagccttgccggggcggggggccacagcactagtgcttccctggccacgcccatcaccaccttgggcaccattgccaccctctcaagccaggtgatcaaccccactgccatcactgtgtcggccgcacagaccacgctgacagcggcaggcgggctcacaaccccaaccatcaccatgcaggtagggcagggcctgaggccacgtgtgggcgagggaccccacacaagtggaagcacgtgaggctcacgccgtccgtccacaggcctttccttcctggtgttgcgctgctgccgggtgcagccatggcaggcctttcctcacctggggcattttccctggtgtcacatggtccctgtgtcatagtccgtggtttggctgtcatggtttggccatgcctggtgtttgaacaccgggttcttcctctcgcagtgttctacaggacgccgcagctcgtctgcatgtgtgtgcagtgttctgttcatacatattaaggaaaacggtgaaacgtttgttgttggcctttgagcattgagggggatttccattctctgacaaaggacttgacttcagccagcctcctgccttccccttgccctgtcctcacagcctcttcctcatcccagttgcctttgaggcaaagtggtgcctcttccctggcctctgagcaagtcagtgtcttgggggcaggggtgagtgggtcttacgtctgccagggccgttgagaagtggtcagtggtcccagcctgtgtggtgacagtgcaggacagtgggagggacaggcagacagccagctgcagcactaactctcctcctcgtgtgtctccccagcccgtgtcccagcccacccaggtaactctgatcacggcacctagtggggtggaggcccagcctgtgcatgacctccctgtgtccattctggcctccccgactacagaacagcccaccgccacagttaccatcgccgactcaggccagggtgatgtgcagcctggcactgtcaccttggtgtgctccaacccaccctgtgagacccacgagactggcaccaccaacacggccaccactactgttgtggctaaccttgggggacacccccagcccacccaagtgcagttcgtctgtgacagacaggaggcagctgcttctcttgtgacctcgactgtgggccagcagaatggtagcgtggtccgagtctgttcgaacccgccctgcgagacccacgagacgggcaccaccaacaccgccaccaccgccacctccaacatggccgggcagcatggctgctcaaacccaccctgcgagacccacgagacgggcaccaccaacactgccactacagccatgtcgagcgtcggcgccaaccaccagcgagatgcccgtcgggcctgtgcagctggcacccctgccgtgatccggatcagtgtggccactggggcgctggaggcagcccagggctctaagtcccagtgccaaacccgccagaccagcgcgaccagcaccaccatgactgtgatggccaccggggccccgtgctcggccggcccactccttgggccgagcatggcacgggagcccgggggccgcagccctgcttttgtgcagttggcccctctgagcagcaaagtcaggctgagcagcccaagcattaaggaccttcctgcggggcgccacagccatgcggtcagcaccgctgccatgacccgttccagcgtgggtgctggggagccccgcatggcacctgtgtgcgagagcctccagggtggctcgcccagcaccacagtgactgtgacagccctggaggcactgctgtgcccctcggccaccgtgacccaagtctgctccaacccaccatgtgagacccacgagacaggcaccaccaacaccgccactacctcgaatgcaggcagcgcccagagggtgtgctccaacccgccatgcgagacccacgagacgggcaccacccacacggccaccaccgctacttcaaacgggggcacgggccagcccgagggtgggcagcagccccctgctggtcgcccctgtgagacacaccagaccacttccactggcaccaccatgtcggtcagcgtgggtgccctgcttcccgacgccacttcttcccacaggaccgtggagtctggcctagaggtggcggcggcacccagcgtcaccccccaggctggcaccgcgctgctggctcctttcccaacacagagggtgtgctccaaccccccctgtgagacccacgagacgggcaccactcacacggccaccactgtcacttccaacatgagttcaaaccaaggtaagtgaaggtggccagcctggctttcatggtctcccagccccccaggctgaaaggccaagacaacgatggcgggggtccgtccagagtccaccagtcaggctccttggcacccaatttaccagtggggagagctggggcgtcctggctgtacctgaagcagacagaggtctccaggagcctgtcctgccttatctggccctccccttggtggtagaggaagcctgtggtggtcaagccaagtacaggccgggggggctcctgctgagcagccgcctgcctgtcgcccccacagaccccccacctgctgccagcgatcagggagaggtggagagcacccagggcgacagcgtgaacatcaccagctccagtgccatcacgacaaccgtgtcctccacactgacgcgggctgtgaccaccgtgacgcagtccacaccggtcccgggcccctctgtgccggtaagagcccagggggccgtgttcttccccgccttcccggcctacgcccgtgcagttccacactcagacgccagatgtcgctcttgtaccaggcatggggccgctcctggtcccttttccggaccataaaagggcagcctcggtgcctgctgcggcaggaggcaggagcctcaccgtcccccgcatctctggggcgcttttatttctgggactggttctcatcgcgtgtcacttcaccgcagcctgtataagacatggcgggggtctgagtgcccatttgtccaggccagggtgactgaggacgggttaaacctgaccgggggtctcaagggcctttctcctcatgctggtcagagaaccactgtcccctccctatttaacatgggctggagctggcccatcaagaatgaaaacttaggcccacaaggaaaggtgagggctggcttgcttctcagccctgctgcctggctctggcccctctcctcccctctgacaggggcttctctccctttctagaagatctcatcaatgactgagactgccccaagggctctgactactgaagtccccatcccggccaaaataacagtgaccatagccaacacagaaacttctgacatgcccttctctgctgttgacatcctgcagcccccagaggaactccaggtgtcgccaggtcctcgccagcagctgccgccacggcagcttctgcagtcggcttccacagccctgatgggggagtccgccgaggtcctgtcagcctcccagacccctgagctcccggccgccgtggatctgagcagcacaggggagccatcttcgggccaggagtctgccggctctgcggtggtggccactgtggtggtccagccacccccacccacacagtccgaagtagaccagttatcacttccccaagagctaatggccgaggcccaagctggcaccaccaccctcatggtaacggggctcacccccgaggagctggcagtgacggctgctgcagaagcagctgcccaggccgcagccacggaggaagcccaggccctggccatccaggcggtgctccaggccgcgcagcaggccgtcatgggtgagtgccggtgcaaccctggggaagccgggccgctcgggggagcaataggccgcggagacagcctgggaagaggagcccatttccctcgagggtggcatgagccagatgtgatggggaggacgagcacaggggaccccaggcaggccaagtagtagagactgccgtgtagaacaggctggctggggttagcgcctgggaaacaggcagggcccctcggccagggcttagcctacagtggagcacggtaggaggtggacggggtctctaggacaggctttgggggcctccgcccgggctgcccgcttctggccagccttcctagtaagtagtgtttctctcgaccctggagcaggcaccggcgagcccatggacacctccgaggcagcagcaaccgtgactcaggcggagctggggcacctgtcggccgagggtcaggagggccaggccaccaccatacccattgtgctgacacagcaggagctggctgccctggtgcagcagcagcagctgcaggaggcccaggcccagcagcagcatcaccacctccccactgaggccctggcccctgccgacagtctcaacgacccagccattgagagcaattgcctcaatgagctggccggcacggtccccagcactgtggcgctgctgccctcaacggccactgagagtaagcgactgagggcgaattggtgctggggtggtgggggcacccagggaggtgagggcaggacgggaggctcggtctcacttgggagccaggtttcccgagtctttcccgctgacaccttctttcttcctaggcctggctccatccaacacatttgtggccccccagccggttgtggtggccagcccagccaagctgcaggctgcagctaccctgaccgaagtggccaatggcatcgagtccctgggtgtggtgagtcgggtgtgttggggctcctgagtccgtggcctggggggcagcactgcctctaggtgctgagggcctgatctcgtcgcaccgattctgtcttgcagaagccagacctgccgcccccacccagcaaagcccccatgaagaaggaaaaccagtggtttgatgtgggagtcattaagggcaccaatgtaatggtgacacactatttcctgccaccagatgatgctgtcccatcagacgtaagtgtccccaggtgctgatgtcctcaggtgggtgggtcttggctccaccaccctgagcggggcttacaggaaactcctccatctttgggccaagctgagtagccaggaagcctgaggaaggtgggcagagaccatcccccctgaagcagtagaaaaggagagctttggttccttcccgccagtaccgggccacagtcagcctcgccacgtccctccttgccgtgaggggccagccaccgctgacctcttttccctctggcccatagttaccatggacctgcagtgttcctggggtggcccagagctgccttctccacagtggcgttcatgccactcctcttttcctaggatgatttgggcaccgtccctgactataaccagctgaagaagcaggagctgcagccaggcacagcctataagtttcgtgttgccggaatcaatgcctgtggccgggggcccttcagcgaaatctcagcctttaagacgtgcctgcctggtttcccaggggccccttgtgccattaaaatcagcaaagtgagtcttgctgtggggtggccgtctgtccctggttggtttctgcctgcctcagcacatgaggtggccgggggggggcataggagagctaggttttgagtcccagtttgtcttagtccttccacttgggggaagatctctttgaagctccttgaactaccacatggaatatctctactgtgttagaaaatggcttatgggaaccatgattagtcagttctggaagcctctagcctgttctgttgaccttctgaccccctggcttctagagtccggatggtgctcacctcacctgggagccaccctctgtgacctccggcaagattatcgagtactccgtgtacctggccatccagagctcacaggctgggggcgagctcaagagctccaccccggcccagctggccttcatgcgggtgtactgcgggcccagcccctcctgcctggtgcagtcctccagcctttccaacgcccacatcgactacaccaccaagcccgccatcatcttccgcatcgccgcccgcaatgagaagggctatggcccggccacacaagtgaggtggctgcagggtgagtgtccttcgtggagctcttcaggcacagggaaggcccaggaagccgggtgcagcaggaggaactgtcaccatctgagattttttcccatgtgcggcgtctccctgcttcctttggcgcgcacacagccccccacgggggtggccatcaagtagagcaggggacccagctccgggcctgggggtgcaggggacgccaccccaggatgtttgaggggacaagcagtgagagggctggcgggaaagtgtaggtttccaggcccgaaaacagcacgtcccaggtccctggagtgcagcaggtgagggatggaggccagcctgcctcctgtcaggtcatgctcctgctccagctcccctggggctctgggacctgggagggcagtgagaggtgggagctgagctgagtgggtttctaacctacgtccagaggggagtgagtggtgtcgtgttctggtcccaaggagtggcgtaaaaggtgaccacccatagggcaggcgccccacccttgccagctgcgggtcatgccatgtggcaccaagagactctgcaggcgggcagggcgcatgtgttccttgctctcgttctgtcacaatgctgctcacgcatctctcccgttccttccagaaaccagtaaagacagctctggcaccaagccagccaacaagcggcccatgtcctctccagaaatgtaagcaggaagcccctctcgggaaccttctgagactaggggtggaaatagctgggttcagcctcttgtcaaatgactgggggcccctaaccggccctgcaccagcagggcctccagtggtgcagggcccacactaactttctctttcctttttctgccttccaaggaaatctgctccaaagaaatctaaggccgatggtcagtgagaggaagctgactagcccctggattcttctccagacccccctgcttcaggaacacccgccagggcccacccctcccaccccgtcccagcattcgcacttcaccctcgcgagccgctgttcactcctctcccctttctctttctctctgtttttaaaataatctaaagaaagcacattttaccattgctgttgggaggaagcagaggcagatgggaaagcagagagaggagcgcgcttcctttcctccccgctgccgcccaccctggggagagacttttgcggggagggaaggcggagctgaggacagccagctccgccctcccaaggctgtgcgttcctgagggccaggtcgggggcaggcatggaggggaggaaaggcgtccctcttggccctccccagagtggctttcctggcaccctggcctgggtgtctggttctgttttcttttcttccccttgtgtttccagtcacctaacttcccttcctcaggctcccccggcccaccctgctcagtgaccccacaggaagcttacacattttctcagaggcctttgtgctcccacctcttctaccctccccctcttctttcccattttaaaaaagaaaagaaggaaaaagaaaaaaggggcaaggagccccgcggcggcctgggcagcgcctgtgcagacctccctgcaggccgcactgccaactgctgcatttgttgtgttttttaggttgcaattggtgaagttcacactttcattgtaattttagcgtgtggggttttgtcccttttttgttgttgttagctgtgtacagaatgtgtaatcttttttcttttctcttttttttgttttgttttgttttgtttttgtttttttacttttttcttcttggctaattcttggcagggatctttctggaggaaaagctggggccagccagggcaggagaggtgtgaaatctgccacgaggggcctgctgtttgccacccagcccaacttcctgttgctggcccctgccctctgcccttttgcctgtcctcaggccgctggaacaaaggaaggacagctcattcctcatgggcgatcactccgcatctatagggtcgagcctaggggagcttgagggagggctggggcctccttgtcctggatttccagctctccccatgccccctccctgagcaccaccggcaccgcctcccaaacagggctgctggtttccgcagccactgctccacctcccccaaatcgtcatggaaagggtggagaatggaggggaaccaggcgtccttggaggcagcttgggagggtgactgtgtagtgtcacccacaagggaggctagggcaatggagcaggccaccagcagcagctgtgcagcatggaactcaggccaggctccgaggctgggggatctgcttggagttttctgccccccaccccaaacttctgtcgaggagcaaggcttgccagcaagtcagaaggatttgaaccgagcagccaatctttccagccctcccctaccgacctctgcctggagacgcagcagcctgtgtcctccagggcctctggtttgttgtattatagtatatttcgctgtggaaaatgtcacgtttagtcaccttggagcccactcacctggtcctgttgttttaccccatcccttctctcgcgcgcctattgatttgtttctgaggagagtacaccgttcactattgtagagtaacccctgtgactcaatattaccatagtgcgatgtcgttttgtgctattttgaacaattaaaagactttttttgaaataaccactaggtgtctcactgtgtcccggcatcctctcaggaagcctgagcgggaaggctgagacctgcccgaggctcacgggagccccctggagggagacctgagctctggtgaaagcgtagaaggccccagagtgaggcctctgctgtggcctccggtctttggaccaagtcggaccagggtccagcaggttgcttggtagctgccttgcagggcaagggccaaagagccccttgggcagctgctgctgacttcctgtgtctggggcccagatctccctccctcccctcctgcactagaggataggatggggcaagggcctggcaggtcaccagcggcagcctccttgggtgggttggggggaggtgggctgagtcaagtacaccacgggtactgcagaggtggatcccttcctctggcttcctcttaaatgtgagccatgcccccaagggaagaagcaagagcttgtgatccagactgaccacctagcagctgggtcggtaggacagctgggatcccgtgggctgaatttgtaccaggaggcccagaaagctccggggcaaggtggccggagcagcacaggcctaggcgggtctgaggggagtgacaccctgcttctggggcctggtgctcctggcgcacctgcattccccgccccctccaagcccctgccgcctgcctttgtttcccctacacacctctactgcccagccttcctctcagagcacccaggcactccgctaccagaagctcctggagtaaccaaagcctccgtgtctccacctgtggcatgggtgtgtgtgcaaggccctgtcgaatgcgacctcttctgggaagcctctgtcctgtggggtctgctgtgtcatgtgggggtggggggaagcagactggccagggcttgacaccaggagccatggctctgtcttacccaccgcaccaactgtgacctgccttggagcctagcctcgcagaggcccaaggagaggggtgggaaagtgtccttcagagcagagcggtaggagtcatggctggggctggtggaggccaggggccacatggggctggccccagaaccgaggggccttgcggatttgccatacctttggcaaatggcgttgtgggcgcttcgcctggtgggggtggtacaaggcttcttcctaccccacttctgtagctggcacctgtggggctacccaccctccgcattccttcagctcacttgtctcaccgcggctgcatcacactccacaaggcaagggccacatcagtcatgcctctggtgtttatctgaaaataccgcgtttccgtctgagggcaccactcagtctggggaggcaggagggaggctggacatgaatgtgaacatgacaggcctgtgagcagggcaggtagatacagcccggctgggcacaaagctcatcccctgagcatgagccgaggccgagggtgggtgggagcacacagaggatgcctccccagctgccagggcatcagcctcattaccaagcaccccaaaggggaactgtttggggttgggtgggtcagcctgcagcagggactgagacagccactgtggcatcaaagaccagcagtgcagtacccacgcccagaggctggaacccattttgtgcactgttggcctggaaggtaggaaccacctcagcccagctgccttgtagcatcatcgggtcagtcatagagctacagacagatctgggcagctggaaaacaggcccagagaaggggggtgtgggctgttacctgcagttactgtctggccttagagctgtgtcacttgtgtaaagaagtcagtgccaaggccgagcgcggtggctcacacctgtaataccaacactttgggaggccgaggcaggtggatcacgaggtcaagaatttgagaccagcctggccaacatggtgaaaaaccgtctactaaaaaaaaaaaaaaaaaaaaaaaaaaaattagctaggcatggtggcaggcacctgtaatcccagctactccagaggccgaggcaggagaattgcttaaacccgggaagcggaggttatagtgagccaagatcatgccactgcactccagcctgggcgacagagcaagaccccatcttgggaaaaaaaaaaaaaaaattagcgccaatggctgcccattactgactgttgaggtagttggtgacaaactgattcaaaagagaggacttgctaggctgggtgcggtggctcacgcctgtaatcccagcactttgggaggctgacgcaggaggatcgcttgagcttaggagttcgagaccagcctgggcaacattgcaaaaccctgtctccactaaaaatacaaaaattagccaggcatggtggcccacacctgtggtcccacctactcaggaggctgaggtgggaggatcgcttgagcctggcaggtcaaggctgcagtgagctgcctgggcgacaggacactgtctcaaaaaacaaagaaacaaacaacaacaacaacaacaaaaacagaacttgcctcctgtctaccctgtgtggtgacaggtcagagggacctctgcattcaggcccactagctgttccctgtcctgctgcacccctgccccacaggcttggtagggccaaggccctcagccgccctgccggggcccctggtgtagggcggggtgggtggcagccccgttccccctcatcccagaccctccggccatcccagcttttcccaccaagcaggatcttgagaccagagctcccagcaggggccctggagggactggcccattcgagtggagggtcgcggcaggaacaagtgcgggggtcgggctcaaagccccgccccaggcccagcggaaccctgaagaggagggggagggtgagccgggcgcggctgtgtcagctgagtgacagtcacgggaccgcgaccaactctgtctggcttcctagaggagcaggagggatgagcaagggtctcccagcgcgacaggccagtggtggggtgcttggggggagtgctgtcttggagggtcccggggatggtgacgtctgaagccccgtgcagaggtggggagatccctgagggctggttcccgaggctgggggggcctaggtcccatgtgggggctgcgccttcaagccccatttcccctaggacatggagaaagagcgagagactctgcaggcctggaaggagcgcgtggggcaggagctggaccgcgtggtggctttctggatggagcactcccacgaccaggagcacgggtactcggcgtgcttctggagtcctcagcagggtttttgcccttcctgaggccccttctcactctcaggcacctcacagatttgctggccccagaggggcaggaggggctggcaaggcccgttccagactttgctaaccctgccttcccacaggggcttcttcacgtgccttggccgcgaggggcgggtgtatgatgacctcaagtatgtgtggctgcaggggaggcaggtatggtgttcccagcctggaagctcaggcacacggcccatcgcctcaaaggtctccccacctcaccccagccggccacttaagccactttccctcccgtaccccgcaggtatggatgtattgtcgcctgtaccgcactttcgagcgcttccgccatgctcagcttctggacgcagcaaaagcaggtaggtgcccccttcctgcccatctcccagtgactccgtccatgtttactcaacagggcacatgtgcggagttcctagagggatctagaagcagcgaaggacttggggaggctcaagggtggtgtgtgcggggcgtcctggccttacccctggcatgccaaccccccaacctccaggtggtgagttcttgctgcggtatgcccgggtggcacctcctggcaagaagtgtgcctttgtgctgactcgggacggccgcccggtcaaggtgcagcgaaccatcttcagtgagtgtttctacaccatggccatgaacgagctgtggagagccacaggggaagtgcggtaccaggtgtgtgagaggagggtgcccctgaagaccccaccctgcgaccctgccatggccacctgatgcattcccactcactacgcaagtcccctcccatggacccatctgtgggccaagtccccttcacctctgaacgctcccctacccccacaggggcgcagacggagagggccctatccacgccctgcccccaactgggaaaaggcccttccctcctccctgggctccctgtgctgccagaccctgaccccacagcctggaaggggctgcacccccagactgggagcagagtggggcggatctgactggcccctactggacgctgggtgccaggccccaagtaggccctggatgaaggtgtctctgggttcaggagaggaattggctctcccaccccagggccgtgtccagggggatggcacaggatgtagcctcagcctgggcctccccttgcctcctgcacccccagacggaagcggtggagatgatggatcagatcgtccactgggtgcaggaggacgcgtcgggactgggccggccccagctccagggggccccggctgcggagcccatggcggtgcccatgatgctactgaacctggtggagcagctcggggaggcagatgaggagctggcgggcaaatacgcagagctgggggactggtgcgcccggaggattctgcagcacgtgcaggtgggggatgcctggggagctggggtggtgggaggccttccactcccccactcccctgggcaccctggggctcgacacacctggagagacagagattcggggatgtcccacctggggaaggtggagggcctgagggctggagggaggatgcggagccccaggcaagccctgacagaaggagacccctcctgccccacccaagtcccttccaggcctctgggccgtgaaacccgccctgtctgtccccattcaatgtttcaccctcccctgctggagaggatcaggccagaagtgaggattacatcttcctaggcccgggctggacgcggtggctcgtgcctgtaatcccagcagtttgggaggctgaggcgggcggatcacctgaggtcaggagttggagaccagcctggccaatatagtgaaaccccgtctctactaaaaatacaaaaattagctgggcatggtggtgcatgcctgtaatcccagcctctagggaggctgaggcaggagaatcgcatgaacccaggaggtggagattgtagtgagtcgagattgcggccactgcactttagcctgggtgacagagcaagactctgtctaaaaaaaaaaaaaaaaaaaaaaaacaacaacttgctaggcccaagggagtgaatcagcccctccttaaatgcccctctgagcctggcccacccaagccagcaggtccaggggcttgggtaagagggagggaggaagggctttccggagctgggtctttctagttgggtggctgggtgggtgaaagggctggaggcaacattcccttctgctccttcccggtagagggatggacaagctgtgctggagaatgtgtcagagggtggcaaggaacttcctggctgcctggggagacagcagaacccaggtgaggggcggggtgggctgggggccacccaggaggaggggagcgctgagccttgtgttctgggcttcagatatgggagtgcctggcgggggcgccttgaggaggcagaggagcgaggatgggcttcccaaggctgggggtttctgcagaggagcaggcttccagggccagggagctcagagcctcgctcattgttagggagggagcagagaggtgccaggggcttttgctccctctgttccctccctcaaccccaccccccgccccccgcccttccgtactccacccctcaccaggccacacgctggaagccggctggtttctgctccgtcattgcattcggaaaggcgaccccgaacttcgagcccacgtgattgacaagttcctattgttgcccttccactccggatgggaccctgaccacggaggcctcttttacttccaggatgctgataacttctgccccacccaggtgggagagcgcccagggccatgtgtgacccacgctgttctaaggctttctgcccagggaggtggttgcttctctagagggtaacctggggctggattggaacctagaggcctgctctcagcttctgtgccagtgttacaggaaaggggtcgtgatccagaccccagaagagggagggttcttggatcttgcccaagaaagaattcagggcgagtccgcaatgcaaagtgaaagcaagtttattaagaaagtaaaggaataaaagaatggttactccataggcagagcagccctgagggctgctggttgcctttttttttttttttttttttttttttgaggtggagttttgctcttgctgcccaggctggagtgcaatggcgccatctcggctcaccacaacctctgcttcccgggttcaagcgattctcctgccctagcctcccgagtagctaggattacaggcatgggccaccatgcctggctaattttgtatttttagtagagacggggtttctccatgttggtcaggctggtctcgaactcccgacctcaggtgatccgcccgcctcagcctcccaaagtgctgggattataggcgtgagccaccgcacccggctggttgcccatttttatgcttatttcttgatgatatgctaaacaaggggtggattattcatgcctcccctttttagaccatatagggtaacttcctgacgttgccatggcatttgtaaactgttggaagtgaggacgagcagaggtcactgttgtcgccaccttggttttggtgggttttggccggctcctttactgcaacctgttttatcagcaaggtctttatgacctgtattttgtgccgacctcatatctcatcctgcgacttagaatgcctcagccgtctgggaatgcagcccagtaggtctcagcctcatttgacccagctcctgtttaagatggagttgctctggtttacacacctctgacaccatgtcatatggaggccaccagggagctggcgaaacgctgatgctcagacatatatgccattcgtctggggccctggtgtctattcaagaatctacaggtcaggaagctgatatcactgggaggggtccttcagaacttccaaagatgtcccgcaattcacctccagtagcttgggccaatggagacgcagccaggtctggaaagttgcggaggggagtttcctgctgagatgcctgcccctgctctcccctcagctggagtgggccatgaagctctggtggccacacagtgaagccatgattgccttcctcatgggttacagtgacagtggggaccctgtgctgctgcgcctcttctaccaagtggctgagtacaccttccgccaggtgagagctgcctccttgtcccctctagaggctgaatgggggaatggggggagtctggcccggctgcgctcttgccccctcgctgagcacagtcgctcagctggtctgagagtttccggagccccagtgctgttcgttcagtcaacgaagaagcctctgccctcctagagctcgaattttggtggtgggggcgggaggagcagagtgtaagcaagcagacctaggtggtggtgagagtgacagctgtgggaataataccactggagagggttgtgggggggctctttcctatggggtggcagcagggaagcactgagcaggggccgagtcaatcaggggtgtgtctgagggactgggagtctgggcagggtggggcatgtggcacagcaggggggcctggcagcccgggaggataaaggcagagtgggcaagggacggactccagctgcctggtctgattccattgttacctgggtcctggggcttggaggggagggtgttatgggggaagtctgtagggaacagggcagaagctgggacagcagaggaagctgtagctgtcatcccagccagtgagggctggcccaggtgggagctggtggggacagagggttcacagtctggtggagcagcagtgggattcctgagtctccagttcagacggagagatctggactcaccatgaatgttttcagtatcacaagaatgtagatgctgcctggcacagtggctcatgtctataatcctagcactttggcaggctgagacgggaggatcgcttgaaccgaggacttcaaaaccagtctgggcaacataacgagacctggtctctacaaaaaattttaaaaaattagctgggtgtcatgcacacctgtagtcctagctactcaggaggctgaggcaggaggactgcttaagcccagtttgaggctgcaatgagttatgatcacaccactgcactccagcctgggctgggcaacagagcgagactatgtctcaaaaaaaaaaggccgggcacggtggctcacgcctgtaatcccagcactttgggagactgaggcaggtggatcacctgaggtcaggagttcaagaccagcctggccaacatggtgaaaccccatctctactaaaaatacaaaaattagccaagcgtggtggtgggtgcctgtaatcccagctacttgggaggcagaggcaggagaatcgcttgaacccaggaggcagaggttgcagtgagccgagatcgcaccattgcactccagcctgggggacaagagcaagacttggtctcaaaaaaaaaaaaaacaaaaaaaaaaaaacagtacagatgctgctgagatctatgaggcaaaaagggaaatgggggcccagcaaaggagacaagaatcagtggtgacgcaggaagaaaaccaagccaggggctccctgaagcccaagtgctaggagcagagtgataagctgtcttgactgctgcccaggaggcaactcgagctgctgaacacaggaaagggcatggcacccagtggaaagggcatggcacccagtggaaagggcatggcacccagtggtggcaaggcctgggtggtgaatgaatgaagattcatcatgcgtttctaaagccacgactccgactccactggtgaaccctggtactgcgaggactatagcaggggatcttattctggggtctgtgagcttcgaaaccgggggcggagaatcacatctttatttgtactaacctctaactgaaactagcatttgctgccattatgagtggaggcaatgaaccacattggtaatagaagtgcctggctttgtcaccgatagaaatccagatgtgtttacattgcattgcagttagagagacatctgcaagtatcacatatattcgtcactacttccaaagcagcagggttgttagacctgcagctatatcttaatatttaatgcattcatagagtgtgtgttaggggccaccagttctaactcaaaaatgaaattgaaggaatacattttaataagatatagatgacattaaacaattacaaaagttataatcaacaggtaaatcggctgggcatggtggctcatgcctgtaatctcagcactttgggagactgaggcgggtggatcacctgaggtcaggagttctggaccagcctggtcaacatggcgaaaccccgtctctactaaaaatacaaaaattgggctggtcgcggtggctcacgcctgccattccagcactttgaaaggccgaggcaggtggatcacttgaggtcaggagttcgagaacagcctggctgacatggtgaaacccccatctctattaaaaatacaaaaaattagccgggtgtggtggcgggtgcctgtaatcccaactactggggagactgaggcaggagaatcacttgaacccgggaagcactccagcctgggcaacaggagcaaaactccattaaaaaaaataaaaaataaaaaaaataaataaataaattagccgggcttggtggcgggtgcctgtaatcccagctactcaggaggctgaagcaggagaatcactggaacctgggaggtgaaggttgcagtgagctgggatcacgccactgcactccatccagtctgggtgacaagagcgaaactccgtcttaaaaaaacaaaaaccaaaaaactaaccaacaaacaaaaaaacaggtaagtcattatgcatcaaccaacataacagaatacagaaggcaaaaatccagacattgaaggaaattcttctttaccttcctgtgtcatgtcaagcagtcaaaaaataagtaaggacttgaacaatgtaactcaaaagacagaatgaatacacacagaactagtttttatttatttatttatttatttatttatttatttatttatttatttttgagacagggtctctatcgcccaggctgagtgcagtggcacaatcatggctcagtgcagcctcaacctcctgggctcaagcgatccttccacctcagccacccaggtagctgggactacagctgtgtgccatcacgcccagctaattctttaattttttttttgtatagatggggtctcactatgtttcccagcctggtcttaaactcctggcctcaagtgatcctcccgcctcggcctctcaaagtgctgggattataggcgtgagccactgtgcccagcccaggactagttttacttcctacaaagaagaatacaccaactcttatgggccaccatttaaagagacattttcatagtggacttcaatgtaattgagtccatgatccttttgagaaggggctgaactgacaagcctccctgagacaggtgccccatggaatgctagtggagagagaaggaaagagagtggaatgggcactgggcaggggcagagggaggaggagatgagtttgggaccaatggtgagccaggacaggagtcagatgagattgtgcatctactggaagacaggcctgtgaagccgggaatgggagctccaagggagtcacttcttaagagtttcatgacaggtcgtcgcctccatcagggttctttgtttcttttcttttcctttttttttttttttttttgagacggagtctggctctgttgcccaggctggagtgcagtggcgcgatcttggctcactgcaagctccgcctcccgggttcacgccattctcctgcctcagcctcccgagtagctgggactacaggtgcccgccaccactcccggctaattttttgtattttagtagagacgggatttcactgtgttagccaggatggtctcgatctcctgaccttgtgatccgcccgcctcggcctcccaaagtgctgggattacaggtgtgagcctttgcacccggccgggttctttgtttctttgaatcaacgtaaccacgactacaatcacaatagagaacttttttgtttgtttgtttgttcgtttgtttgtttgtttgagatggagtctcgctctgtcacccaggctggagcgcaatggcgtgatctcagctcactgcaacctccgcctcctgtgttcaagctattctcccgcctcagcctcccgagtatactgctgggattacaagtgcgtgccaccacgtccggctaattttgtatttttagtagagatgaggtttcaccatgttgtccaggctgatcttgaactcctgacctcaggtgatccgcccgcctcggcctccgaaagtgctgggattacaggcgcaagccacagctcccggcccgatagacaacgtttctacaccccagggcagagttctttcattccatctagcagtgtctcatccccttgcccagtcggttatatagttgtagcctgcctgctgcgcccacccctgctttcatctttgtggaggacgcagtgtcgcggttaagatcgctggttctggagccacgtcacctggggtcaacccaggctctgacccctggtagcgatgcagtggcatctgggcgggtcctgcaggcgctagctgtcactgtctctgttattccagtttcgcgatcccgagtacggggaatggtttggctacctgagccgagagggcaaggtggccctctccatcaagggaggtcctttcaaaggtgagtgggggagagggcggggccgcaggggttgcgcctctcggctgcccccggccctcactacctgcccgcctctacccgcaggctgcttccacgtgccgcggtgcctagccatgtgcgaggagatgctgggcgccctgctgagccgccccgcccccgccccctcccccgcccccacccccgcctgccgaggcgcggaataaaggctgagtccgctccacctgcggctgtgcgcgcgtctgtgggctcgcgggaggggggctgtcgcgccgagggaggggccggctccagctccggggcagcgcccgccccgcccccaggcccgccccgcgctgaccggctccgcgcattggcccgccccgtgcgctggcctgtcccgcgcattggccaagcggccgggaggacgggcccggcggccgtgcacttccggccggtggccggcccggcgcgcaccgccccttccgccgtcgcccagcgagcccagctccggtcccagccccggccgtcccggcgtcgcttcggagcgcggcggcagctgactgcgccttcacgatccgctgggacccgcgagccccgccgccgttatgaacatccgcaatgcgagggtgagcgcccggggcgggaggctgtccgcgccgcgtgggcgccgggccgggtggctgccgcgcatgctcccgagggccccggccgagcccggcccggtggccctgagtgtgcctgcggccgctggacctatggggctggcccagcccgccgaagaggccggggcgcggggccggggctgcgattccctcctgtttgcgtgatgtcgggcctccgttgggtgggctccggggacctccggggcgcccactcctgttcctgtgctccgggcgttgtgcaaagtcagatcgtcacagtgcctgcccagccccgagggagcggggccgagcagaccgacggggagcaggcttctcacccgtggtcaccgccgccttagactgagcgcgttccactgccctccttccctgcagccagaggacctaatgaacatgcagcactgcaacctcctctgcctgcccgagaactaccagatgaaatactacttctaccatggcctttcctggccccaggtgggcagcttctgaatttgggcatgggggaaagcaggccgaggaaaatcccatctggccatcttggagggagtggacaagtctgtcagagcccagggggctgtatggtcggtggcgtcctgggtgttttcagctggcagacaggggcaaaggaaaagaaggcgcccgaagggagcagagaataggggcaggatccccactttgcgtcttctttctgggtatgggcagggcacagtgtggcgagggggagaccaagccactcagcccggaggtcatgagccatcacacaactcgccactcgtccagtttgtgtccctctaaagggctcttctagctccgacaagaagttttctcactctgttttcctgtcaccagctctcttacattgctgaggacgagaatgggaagattgtggggtatgtcctggccaaaatgtgagtcaccaaggaggaagacagaagctacacgtgtctggtggatgcctctgtgggctttaaaaaaaatgaataggcttcttcttttcagtacagttgaaagtttatagaaaaattgaacagaaaggacatggagttcttatagcacccctcagcatcccctccctgccagcttcctctgttagtagcatgttggatttgtgtggtccacttgtgacaagtgataaatgaatgtgatatgttactattattattattactattattatttgagacggagtcttgccctgtcgcccaggctggagtgcagtcgcgtgatcttggctcactgcaacctccaccccctgggttcaagcgattctcctgcctcagcctccttagtagctgggattacaggcacatgccaccacacctggctaatttttgtatatttcagtagcaatggggtttcactacgttggccaggctggtctcgaattcctgacctcaggtgtttccacccacctctgtctcccaaagtgctaggattacaggcgtgagccactgcgcctggccgatatattattattaactaaacccatagtttacattactgcacttctctttgtgttgtaagccccatggttttgaccaaatgacatgtgtccaccttcatattatcgcaggatagtttcactgtgttccacgcattcatccctccctctccttaacccgtggcaaccactgattttttactgtttgcatggttttgccttttccaggatgtcacagagttggaatcatactatatacagctttttcaggctggctttttttcacttagtaatacacatttaagcttctgccttgtctttgcgtgggttgacagctcatttctttttttattttttgagacagggtctcgctctgttgcccaggctggagtgcagtggcatgatcatggctcactgcagcctcaacctcccaggctcaagtgatcctctcatgtctgcctcccaagtagctgggaccacaggcatgcgccaccacatccagctaattttttgattttttttttgtagagacaaaaaaaagtgttgtccaggctggtctcgaactcctgggctcaagcagtcctcttgccccggcctgccaagtagctggaactataggcgtgtgccccacacccggcaggcttggggttttcaggcagcagagggtggcaggatcggctgctctgatccaagaggctcccggctctcccccagctggggtcttagggggctgtagtgcatgtccactctacaaatggcaggggggctggaggtggctgtgcctacactgagctcctttgcagcctctcctttctccctctccagggaagaggacccagatgatgtgccccatggacatatcacctcattggtatgtaaggtccacccaggctctctggtgggggtggaagtgggggttagttggggcagccctcaaggtcccagtccctcaccccatctctgctcttctcccaccaggctgtgaagcgttcccaccggcgcctcggtctggctcagaaactgatggaccaggcctctcgagccatgatagagaacttcaatgccaaatatgtctccctgcatgtcaggaagaggtggaagccgggctgagggaagggggattgagggggagagatactgccttgacgggggtcctggggtacctcagcttttggtgaagatccaggaagtgggattggggggaaggagggaccaggaggaggggcaagacctggacgtgctacccctccctggccaaatccgtgcagctcagcagtgccttgttcccctgcagtaaccgggccgccctgcacctctattccaacaccctcaactttcagtaagtagatctcgatttttctaatgggctggggttgatcccaggtctggcccatcagggcacctgagaccggctgagttgccttccaggtcgggggtgggccggctgtggggaagaggctgtggaccccagcactgccaggatacctccacattcactcggcggctgatggttgaaaagccggcatggagacagcacctgcctgctgaaacgtgctccatgtgttgtgatggaggagctctggcccatgatggctgaggctggcgaagggcacacgggctgtttagtaatgtttgggaatagagaggtgtgggtccctggcgtgagcagatgctgaggagcaggactcaagcatgaccaagcacctagaagaatccaagagagagcagaatcgaggagaatgcacattcaggaaggaagggccagtggccaggcagcctagtggatgggggaggtctgcctgaggaccaggaggccccgtgtgcctagcacactagagagaacctggcagttggcatgcccagtagacagtggaaaaaagtgcttgcaagtgaagctggggtgggctgcctgtggagggacactaactgcactcagcccgtttggtaggggatgaagaagagggactgttgggaagggcggtggcctctgggctggatgctggcaagagggatctgtgacccagatgacgatgtctggtgggaattgctttatagctaagtcagcaatcctcatgtcttaggcctggcagggccagcctaggccattgagtccagctccccttccagggacatggccacgcgagtctgcacacacacctgcccagtgtagtcacggccccagagctgctcaggcagggctcaccgtctttcctgggttctgatggctgttgtgaggcagctcagtaagggacagggcgcagggcagggagggaaggggaaggctgaattcagggcttcagctcacaagaaaccgcagaaatggatccttagtatccaggctaaggacacagaacgggggcaggacgggtggggcgggccgctgtgtcctggagcctttgctggagagaacagagggcaggtcacactggacttgttgtctcaggatggagccttcagggagaaaacatggcaccttgctccagtagccacgataccaggagtggaggagggtgtccccgggatacaggtcttcctccttgctctctaaccctctgcccccaggatcagtgaagtggagcccaaatactatgcagatggggaggacgcctatgccatgaagcgggacctcactcagatggccgacgaggtaagcgcctgcatgaagccaagcaaggcgagcgggggcggcactcaggagccccaagacagtggctgcaggcgagaccgactttggatgccagctcttgtggctacgttgccaggagtcacgacctcagtttcctaggctgggctttagaggaggccatctgcctagcagcctggagggtgatgggagaggcagagggaggaggcttttagaagggaagtggggaggtctagggaccagtgggtggcctgcctgctcaaaggtagttctgagtcagggttctgcccaaggctcatcgggtggcagggctggtcaaggggcagcgctctgtcgtgggggcctccatggtagtcggtaagcccaggtagcggtggactggggctccagccaggtgtccccactcagtcccgcgtgtcctgcctagccctgctgcctcactatgcccctctcctcagccagcgacagggccaggctccctttgtctggaaacttaggccctgtctctttgcccccgcttctccctgggttcctggtggcagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctccgtggcactggggaactttgtgtgtgagcgcgcgcacatttagagggtgtgtttctccaggtcctctggtggggatgtgagccttggccttttgacccagagcatcctgccaggcccgagtacaaggaaagagctttggaggtgggactccctagtctcatgaccttcagcagctgtggccccggggaaggaggccctggacttatgggagagaccctgccttggaggtctgcttggccacgctgaatgtgttttgtggcacaagccggggctgctcaggctcaaagctcaacagcagggctcccactcttggtggccttcagttctcttcccaccttcaccttcagactttctctccctaatcacacctgcttcgggctacagcagctccccagcatacccgtgggctccagatgtggacatccaactgctcattgggcttatctacaaatgtcctgtctgagtaatgacccagccagatgccccatcaacagtccttgagtcctccctcccctgccaccctaatggtcagtgagtccatgatacctcttgagtctactccctaacctgagtttgcatttgaaaataatttatttttagtacaattccccgcgtttccccattgacattttgtattagttggtgtatttgttattgttgatgcgccaatactgataagttattgtaaactacagcccatggtttacagtaggtttcctgtctgtgttgtacagtttctatggggttacacaaatgcataaagccatgtattccctcattaacaatttcatgcaaaatacaaaactgggcggctgttgggtgcggtggctcatgcctgtaatcacagcactttgggaggccaaggtgggcgggatcacttgagctcaggagttggagaccagcctgggcagcatggcgaaaccccatctttactaaaaatagaaaacttacccgggtgtggtggtgcatgcctgtaatcccagctactcgggaggctgaagcaggaggatcgcttgagcccgggaggtggaggttgctgtgggccctgatcatgccaccacactccagggacagagacccgtctcaaaaaaaaaaaatatatatatacatatatatatacatatacacatatatatcaaaatcctgtttttcatggagtcaccctaaccgtaacgctcgtttctgtgtctttcctcctttcccttccctcccctccggctgcaaagccatcatttactgtccctagtcctgggcgggccctgtattcctgagccctctctgtgtcctgctactgcaggtggcacactgctcctccgccgggttgaaaactcgccacacaggcctggagctcggttctctttggctggcgcctcgcacgtgaccagcaggcagccggcagctgtggaagcggagcccagagcgcggcagggcggggccggggccggaaaggcgcgtctgcgcacgcccacagctctccgcttcccggctcgggcgaggctgtgttgattggcttaagacgtgggcttccctttgtatgggccggaggcggagtcctgtcccgccccgcgcctggcggcagtgtcttccggttcgcaagcccgcggcgaggttcgttcccaggctctgattggtccggcggcactgggctcgcgcgcagggtgcgggggaagggcgggcttgcgcactgcgtcggccgcgccccggcaccggtggaagggaggtgtcccaggctcccacggcgcccgcggcgccctccttccgccccggccaggcccatgggacccggcccgccctctgccgtccgtccccggcgggcccgatgcctgtcggccgctgagcctccgtccccatgcgggcaggtccgcgccttctgcgggctgcctggcttttggatgctttgaaggggaacaatggagcgaaggatagacggagcagcagggggcagttgcgttcagggccttaaatgccaaacaagtgccctaaaagccagggcccaacactcaggccctaaagtacgggctgaatggggcatcctaggaatagctctggagtgaaaaaaggagtgaagagagcgtttgaaggcaccggctgaggcctttcctgcctgcctgagccctgtggctggctctgctgggtggagggacctttggggaccagtcagggctcggatggaggggcaagatgtgttggggccagctagtgagaggcggggctccctggttccccttggcctgaggcagcggtgggacgtgtgagtctcccgaccaggagcaggttggagtgtgggtgcggctgtacgcgctgtgggcaggggcgcaggctctctagtctcgctggaggactcgaacatcggtacttccgagaccagctgctggaagtccaggtcctgggtctggctagctcccaggccttgaagccccaggtcctgcagacacacacgacgacgtgttcgagaagggccttggtactgggagaagggggcggggagctgagggagtgtttttttccttctgggcaagagaattaattgctcacagttgaaaggcaggaagtacccgcacagcctcccctccccagatctgcaggtcaaggtcatgtgtgcccgcatttgcacagagcctgactctgacatccgtgcacacacacgcctagtacccctgcactagtgcccccacgcccgccttcggaacacacgcctggtgcccaagtgccttgcctctctccccacatctataccccagggatttccctcccaccaaattgaagccagttgtctgcttggcttgtcaaccgcctcccgcctcccgccttcccgatttcccggagaaaagctgctgccctgtggtagagggtggaggaaagccccaccacccctggatgaggggggccccaagacttgcccccagggtagctaagacctcactccgagggggctgcccccctcaggcctatgacgggcaggtgcagctgcaggggaagggaggcagagcagtctcttccggcagcaggaagtggtaaccgcctatggggaaattgtggggctgagcagaaggggaaccggagctgaactctcctcccctaccaagggggcctggagggaacggcagccagctgctgaggttctgctctctggtgctgaccttccttccccctcccctctgaacttcccaccccagctctcaaggctccctggggctccctgggcctctctgggggctgacttgggaagggaggaccccatcggatgtctgggggaaggaggcaacccagggggagtccagagcctggggcagcaatggtgttcatggccactggtacagtgggccagcggccccgctgtgaatggtacagtctggcagtggtgaccagggacagccttctggaggtggtgggatggcagcctgggatgccagcttacgttggggctctcacacctgctccggctgcttggcagcggggctttgggcacaaggcagcctaggtgcaggcccaatgggaggggacggcaaggccggggcacagtggggctggaaggggcgccctgcccccccaggagcccctcgcgggcagtgccagccctgggccgccccgccccaccgggagccgcgctgggggcggggctgggcggagcccgcgcagggtgctggccgcagcgcccccaagtcccggcgccgggcccgctcacggccgcgtgggagcagtggggttcgacggcgcggccgcgaggccgccatggccgctcacgggaagctgcggcgggagcgggggctgcaggctgagtatgagacgcaagtcaaaggtgagagggcgccgggcgctcccggcccgtttcctgcggagaacccaaggtcgtgagggagctccaagcgtccccgcgctggcccagggcccgatgctctccccagcgacctctggagcgggggtggaggagggagcctgagccccttgcctgcctcccgacgcccatttggcctcaaccgcctgccattttcccttccttctttcctgtcttccttcctttggtctctgtcctccttgggtctaccgcttctcacccaaggttcagtggagacactggtggccgctggtaaaagagagccagatgcacccaacgtgcccctcagaaggcagtattttagctacagtgaagtcaaccagcttgattgggctggggggtgagtaagggagtccgggtgagtggattggtggagatcacctggccgtaaccccactgcagtccctggagcttcagcaccttttgcctccctttagcactgagggggagcagaggcgagggccactgtctctgggtcaagctggcgcagtgagtcttggttgagagatttaacagggctggcttctcagccttctgaaattgaacctctgggttctgataaacacccatgtgcaaatcacatgcaaatcagctttgcaaattcttagccaatagcttgtgcccatcttattcagggcatggtaactcttgcaaaggaaagaggcagcagctcagtgccagcagctcgtccatatcactctcaatcactccattttaccaattacggaaacaagctcagagaggtgcagtgacttgcccgtggtcatacagcactgcaacttctaggacgtagaatgcaatgacccttgaagtgcctttgaacccagagatgtaggttctaacatcattattcagtgcaagcaatttataccaaagtatgctccagtcctcctttggaaaaggcagcctgtgtccagagccagcttgaggtgactacacagggtgagccagctttccaagcctcgccatcatcttgctcagatggaggtaatgatctccatcctgcttccccaaaatgccatgaagctgaaagacttggaaaacttcagtcagcaaatatgggtcagtgatttcacactgaaaagttggggtttcgagcacgactgtctaagggttcctcacttgctctgggtctgcatcccacaccctggaaaagcttcctaccattctacaaagtggggtcactgtcttgacaccctaaattctcaaaggtcagcatagcggtggttttggagaccatcttttcttctgttttgcttgtcagcagaagtgagaccaaatgccttgctcacaggaagtgctggtggggcccggggcccagctctgtaattcaggcagacatggattccagctctccttttgccagatgtttcctatacatctgtgctgtcccaggccctgggagtatactgctgtaccagagagaaccccgactccagcccctccagccctggctttttacccagagtaaaagcaatgattcaatgaggactcccctgatttcaaatggcgtcagtggccaccccgccctcacatggctcacgggtctagtgggggagacatagactttgcattatgataataagcactacaaagggaaggaaagtgcacggtgccaagaaggggtcggaagagggccagccctagtttagggggaggtcaggacagggtgtgctgacgagtttgtctgaactgagatccgaaagctctgccaggaaagccaccaatgcaatcgacttgcaattcacaagttgcctgctcaacaccagccggtgtgcatgcccggatctggactaggacatggcttccagtcagcttttgctgccggcagtgatgaagaaaggcagcggttccctctgctggttccttctgcactgttcagttgtcataagtccccagggattgtattcctctgggggaagcagggcagggcaggctccagagggccagtgaggcgagcagttgtctaacacctttcttggaatgaaatgaaatttacttttatcaaaaaatgttaaactgggccaggcgtggtggctcacgtctgtaatcccagcactttgggaggccgaggcgggcggatcacctgaggtcaggagttcaagacccagtctggccaacatgatgaaaccctgtctctactaaaaatacaaaaattagctgggtgtggtggtgcgcccctgtagtcccagctactcgggaggctgaggcgggagaatcgcttgaacccgggaggcggaggttgcagtgagccgagatcgcaccactgtactccagcctgggcaacatcctccgtctcaaaacaaaaaatcaaaacaaaacgttaaactgattcagtgaggactctcctgatttcaaatggcattagcgcccaccccacctggccttggagctgacgagttaaccacaggaggccagcctcggataggatgaagacactctccatctgtctcacttggcatcgtgggctctgccctgctctgtcgggaggtcccgtgccccaggcttccacttacccagcttgatctgccggtgggaagagctctcctgttcagtaattcaattggaagggtcaggctcctgggtccctcacctggctagtctggtgggggcagggagtggagggacagagggatgggtgacgcatgcagccagggctggggcacctggagtcaagggggctgagactaggaaggggacattctccaataggagatcaggggaggaggtagggatgctgggcaggcggaacccacagggtccccatgcaacagcccctgggaagtcactggcgggacagaaatccaatgggattgagctcttctcagcggagtcctccctcgctgctgctggtctgaatcctgccgtcttttgcctggactagcacagtagctgccacctgggctccacctggcagtgtgagggggccctgaaaacgaagctggaccacatcaccccactactgtggctcctctctcactcggagtccagctgggagctctgcccagaccccgggctctgtgccatctgtccctaccggtctctcggactccccctactgcccacgtacagccagctccagccttctgctccaacgatgcggcttgttcttgaccaccctcctttaaaaagaggtcctccctgtccccacccacccctggctctgatcttgctttgtgggttcatcttctccgcacccatcactcctgggcattctgatatgtgttcgtgccccattccaatcccagctccaagagggcagacacttggtcaaacctctttgcctttgtatttaaaacgtgcctgccacagaatgggtgcataatcaacattctgctgaatgaagacatcaattcatgtccctccctggggatgtggatggagatgagtaggtgggcagcctgctggccagaagctgagctagcatcttatttactcgggacgggcactcaggagatggcaaaagtgtcttccgcaggttgcttaaacttgctggacaggcacttctttgcttcaggcctgtgtgggggaagcagcgttgccaaatcaagccagtgatagggtgtcaaaaggccggcagtatggggccctgggtgtgactctctctgcagggtgggggaatgcacaggtggggcggggggtgattgggagtgggaagtggggtcagaagacgggggctagctccctgccccattctttcacttacaaggccggatcagctctccctggctcccagccctcactgtggactgtcctttcccctggggcctgagggcaggcttccccagccactgagactgcgagatcgctgcaggcttgccctgagcagcactgtgatctgtgtgttgtgtatccgtgtgtttgcaagggaggctgccacctcccggagcctgggtaccggcgggaaaggaagtcgcaggggaaaccattcagaggctttccaggaacgagggagagacaggaagccaaactgaaaggtgcctggctggcgctggggcggctctcccctctctctgggacacccttccccttccccctcaaccgggtggctctggccatctgttggcctcagcgcagaggtcggctggacagctgaggccagatctgcctgcaggggcctagcttctttcctcccctcttagctcttgccctcagcctaggctgggtccgaaggagccctcagagccgacgggactggggtctgtgtgcctctgcctctcccatcccacgctggcctggctgacccaggcagggcgtgctgaccaggcctgagccatggttccccccacagagatgcgctggcagctgagcgagcagctgcgctgcctggagctgcagggcgagctgcggcgggagttgctgcaggagctggcagagttcatgcggcgccgcgctgaggtggagctggaatactcccggggcctggaaaagctggccgagcgcttctccagccgtggaggccgcctggggagcagccgggagcaccaaagcttccggtaggtgatgtgctggcaggggggccacggcagggcccaagctccgctcccaggtctcagtgcccctctacccccaggaaggagccgtccctcctgtcgcccttgcactgctgggcggtgctgctgcagcacacgcggcagcagagccgggagagcgcggccctgagtgaggtgctggccgggcccctggcccagcgcctgagtcacattgcagaggacgtggggcgcctggtcaagaaggtgaggctctcatcctgggccacgggaagtgttcgaggctttgggatcaggaggcactgtggctgggagggcactggaggccaggtggggagcaggcagagcgaacctgtgtgcccccccgatggggcttgatctgggcagagcttccagtgcctggcggggccgctctgggcagtgccgtgctcacccttgcctctgcctctagagcagggatctggagcagcagctgcaggatgagctcctggaggtggtctcagagctccagacggtgaggaaagggctggggaggggcctgccccaatggtccagggagaaatgccactcacagtggggaggaacaccgccagaccatcacatcaccccaagccaggctcagggagaagcacgcacctaggggcaaaggcctctctccctaggcacagggcgttaggctaagtgctcacatgggatcgcccagctctgaggtccaagttccagaggggcaggggtagagggctgggggctggcccagccgtggccttcaccagcaccaccttgctttgggtctccctgcaggccaagaagacgtaccaggcatatcacatggagagcgtgaatgccgaggccaagctccgggaggccgagcggcaggaggagaagcgggcaggccggagtgtccccaccaccaccgctggtgccactgaggcagggcccctccgcaagagctccctcaagaagggagggaggctggtggagaaggtgggcctggagggcacctcagacgcaggcctatgggccatgggccctaactaggacctgctgtgctgagggggaagtcagggctgggtgcaggggagggcaggagtggcaggacagtgccatcaggttccagggattccatacggaaggctcccagggcctgagagagtggggaaaacagttgcctggccctggacagccccatgcagcctctccatgctcccagcggggcccctgcagctctgctgttctgccagccattccgtaaggtttcagaggggggcaagaagacacttagggtgggtgatggggtgacacgcacggagaaagggccttcgaggtgagcccagtacagagagtggggaggctgggaaatgcctggatggagccgccaggctgtgcgtggctgacagtcatggtctctgggactctgggagcagaggagggagtcgagcatctcaggtgttcttaggggaaatgacagagtttggctgtgttgggggaaggtctccctggctgctgtggttagcgtgccagctttagccaggtgcggtgactcacgcctgtaatcctagcattttgggaggctgaggtgggtggatcacgaagtcaggagttcaagatcagtgtggccaacatggtgaaaccccatctctactaaaaatacaaaaattagccgggcatgatggcgggtgcctgtcatcccagctacttgggaggctgaggcgggagaatcacttgaacacagcaggcggaggttgcagtgatctaagattgcaccactgtactccagcctgggcgacagagcgagactctgtctcaaaaaaaaaaaataaaaaaaaaatagagtgccagttttagaacccaggtgccagcaggttctgtttcatggctcttgatgatctatccctaccctttggggtactcgttccccctcagctctggcccccgcagaggcctgtggccgcttccagctgtgcacctgtgtgctggctccaagctgggtttctcgtgcaccctccatggtggggtgccatgtgcgcaccttccactcatcaggtatctgtgaatagttctgtgtcatcccccacttctgtggggaatgttgtggctcgaaccaaggcaagtggcgggtgaacagccggggaatcaagtcacctcctggcactgggctgagcacactgtggactgtggcgtggggaaggcagcaggacttctgggcttgaccagttcaggtgtagttgtccacagtgggaggggaggcgatgggcattacatgaaaggctagagataggggctggccacgtgcgtgaccctggcacgcttgcattgtcttgagtagcggcaggccaagttcatggagcacaaactcaagtgcacaaaggcgcgcaacgagtacctgcttagcctggctagtgtcaacgctgctgtcagtaactactacctgcatgacgtcttggacctcatggacgtgagtccttggtgggcaggtgggaaaaggtgcctggtgcctcggggctgggaagctgtggctccaggacctacccaagcatctccttgtttcctcctcagtgctgtgacacagggttccacctggccctggggcaggtgctccggagctacacggccgctgagagccgcacccaagcctcccaagtgcagggcctgggcagcctggaagaagctgtggaggccctggatcctccaggggacaaagccaaggttctcgaggtgcatgctaccgtcttctgtcccccgctgcgctttgactaccacccccatgatggggatgaggtgagggtcaccccctgctgggcttggcattctctggccttcactgtaatggtgggcagtggagtggcatgacccacactttgctcaggaatccaagttctccatggtctcaggcagtgcggcagctagagaagtgtcccacttccatttgcagcctcactccaagggtgcacccccgcaatggccaaggagggcaagacactaactgttcaaaccgtgcagcaggcagccgtgtagctgcccatacattgttctaggctggtttctctgtgtttttaaatttcgtgacacaaacttggcagtaagatggaatggggcttctttatccttctccgtcgagctagtttttcctgcagcagtttatcctgatgggcattgtcaatgatctgggattacattgggcccctttcgggccgacttggaactttacgaagagtccggcatcaccagggcttccgatggcgtcacagctgctccctaacccacccctcccgttcccagctcccacccccagaaacagccacccacctcccggtgtcaagcagccattttccattggccaatgatgacccagtgccaccagcatctctcacagccaccacacgcttccctgcatcttgttctcccagtgggcttatcccagaatttttggctaaattaacattcaatgtttaaatcaccatgacaacaggtactgttggcagctgagccatgtactgtattaggatcacatgtccttccttggacaatttttccttttcttctggaatttataactctcttgcctcaggaatgctgcttgctagaacatgcccattgctaggagttgatcgctacctcgtcccagcactgtcctccacaccaggcacctgtgaggtcaaccttctcctctgcgccctcccccagagccttccagtctggagtgcttcacttctgcccagtgctctgtttccggattccacggcagcagctttcttagtttgatacccttattttggtgacaccttcaccaagggtttcctgactttgcacatctgaaaatgtctgtattctttgttttgttttgttgtgttttgtttttgaaacagggtctcactctgtcccctcggctggagtgcaggggtgtgatgtgatctcagctcactgcagatgcaaccttctggtcctcccatctcagcttcccaagtagctgggactacaggcctgcactacaacgccaggctaatttttctatattttgtagcaagggagtttcaccatgttgcccaggctggtctcaaactcctgggctcaagcaattggcctgcctcggcctcccaaagtgctgggattacaggtgtgccactgtgcccggccaaccctttattcttatttcatgaatacagtacttcttgaatctttctgaagcttttattttttttgagatggagtttcccccttgtcgcccaggctggagtgcagtggcacgatcttgacccactgcaaacttcgcctcctgggttcaagtgattctcctgcctcagcctcccgagtagctggaattacaggcacttgccaccacacctggctaattttttaattttttaaatttaatttattttatttatttattttttgagacagactctttctctgtcgcccaggctagagtgcagtggcgcaatgtcggctcactgcaacctctgcctcccaggttcaagcaattctcctgcctcagcctcctgagtagctgggactacaggtgcccgccaccacgcctggctgatttttgtattttaagtagagacagggtttcaccatattgtccaggctggtcttgaactcctgacctcaggtgatccgcctgcctcggcctcccaaagtgctgggattacaggtgtgggccaccgtgcccgacccttttatttttattttttagtagagacagggtttcaccatgttggccaggcttgtctcgaactcctgacttcaggtgatctgcttgcctcagcctcccaaagtgctgggattacaggcgtgagccaccatgcccggcctgaaatgttttttgttttctcctgttcctgcatttgctctattttcttgcttttgttcgtgagtccaaaatccctgctatatcctttccagagagcaaatagttagttttctgctgatcgtgtctgtttggtgattcttggccatcagttcatatttaagaagaggcctgaacacataccccacaaatgtgggtgtctgtggtgtttcctcctggcccggccagtttccccagtagaaactcttctgaccctgtctagggaggagagggggtgagagggctgggggctcactctgctgtgtggatttccttggaactacctggttttagttccacaccctccagccaaagcctagcaggaacagccctataatctccattgctggagggagccctgctccgtggggagcctggggcctctcagtgagagggtagtggaaaggccttagaggacttgggcttgccttaggggatctgggggagggcccaggtaagtggggcttggtcctggattggatgccttctggaagcagggtaattgtatgattggatgtcttgattaatcttatctagaaagagacagtgatggaggctgaagtgatgcaaggaagtgacagtcacttacattagccaggatggagggatgattttgtggctcggaagaagttcttgattttgtcctcactcatgcgtgatcgcagagtggtcttgtttctgtcttcgcccatcaaggtcacacagtggccttgcctgatgttgatgctctgggtcatttccggtgttcagcaggacagcactgaggccgggctgataggaccaggccagcttccgatggtggggctgctgtgttctctcatcttcctcatctgggaccagtgtccctgagtccaaaatccctgctatatcctttccagagagcaaattgttagttttctgctgatcgtgtgagtttagaggagggataaaatttcaatgttccccagagtatgcatacacttattttttctctagagagagggtctggctctgttgtccaggctggagtacagtggtgtgatcatagctcactgcagcctccaactcctgggctcaagccatcctcctgcctgagcctcctcctgagtagctgggactataggtgcatgccaccatgcgtggctaagatttgtactttaaaaacaattatttttaacctacttatttatttatttattttgagaccaggttatgagacagggtaatttttgtatttttggtagagtcagggttttaccatattgccaaggctggtctcaaactcctgggctcaagtgatccacccgcctcggcctcccaaagtgctgggattgcaggtgtgagccagtccagcctagatggacttttaaaaaaaggtgtggcagaatacacatagcataaaacataccacgttcaccatttgtaagtgtgcggcccaggggcagaagcacattcacggtgctgtgcagccatcaccaccatccagccgcagaacttgttcatcttcccaaactgaagctctggccccgttcaaccccaactccccaccccccagccctggcacccacccttccactgtccgtctctacagagttcacggctctcctttgaggcccctcacaggagtggaatcctacagtgcgggcctttctgtgactggctcctttcactgagtcccatgtcctcaagggtcagccatgttggagcccatctcaaaatggccttactttctactctgtgacttgcgccttcatgcagtcctgtacggcggggcttggtggagatggagagcagggcaagtgtttagccacagctgaatcctcactctcaattttaactgtaatgtcaattttctagatgtctacatgcttaaaagagtaattccttcctttctaaagcgttggctcccactctgcccatgaggcaagctgctctcatcttgccacagggaaatttatgtctgcccagttacagtgagcagtttttccgtccactcctttccctggaagaggtggggctgggctctccctgttctgtctcagaccccagtcttccttaccattctatttcattttattttattttgagatggcgtctcgctctgtcgcccaggctggagtgcaatggctccatcttggctcactgcaacctccgcctcccgggttcaagcgattcccctgcctcagcctcccaagtagctgggactacaggcgcatgccaccgtgcccagttaattttttgtatttttagcggagacagggtttcaccgtgttggccaggctggtctccaactcctgagttcagataatccatccgcctcagcctcccaaagtgcttggattagaggcgtgagccactgcgccgggccaccattctgttttaaatagagttttattaaggtacgattcatataccataaaattcagcactgtaaagtgtacaatttggtggttgtgcagccatcaccatgtaattccagaacatttttgtcacccctaaaggagccactactccccgttctcctctccagccccactggcaccccactgctccagctggcacccactctgcttcctgtctctatggatttgcctggctggacacttcacataagtggattcattccttctcgtggctgaatcctcttccattctgtgggtagaccgcgctgagtttagccatccgtcagttggatgagtggtgccgccacgaacctctgtggacaagtcttggtttggacacgtgtgttcactcctgccattcttcagctgagcgtctgggctggtggtcctgtgcccggccgccaggccacaaaagggtgcttgcttcccttatgccccggggatcttggcacctactgcccaagcccagcccttagccccctggccgccgccctctgcaggtggctgagatctgcgttgaaatggagctgcgggacgagattctgcccagagcccagaacatccagagccgcctggaccgacagaccattgagacagaggaggtctgggcagcccaccgggggttagagggagacgagggcctggagcctgtacagcctgctgttggaagtggctgccctgcctgcccccctccctttggccccttccttctgacttggacttcctgtctccctccctgtcccccacctcttaccaccctggtgtggtctcctctgcaggtgaacaagactctgaaggcgacactgcaggccctgctggaggtggtggcctcggatgacggggatgtgcttgattccttccagaccagcccctccaccgagtccctcaagtccaccagctcagacccaggcagccggcaggcgggccggaggcgcggccagcagcaggagaccgaaaccttctacctcacggtggggagggctgggctggtgggcgggacccgtgggggcattgctggggcagagggaggggctcaagccagggctaacacttggggctcttcttggggctgcccagaagctccaggagtatctgagtggacggagcatcctcgccaagctgcaggccaagcacgagaagctgcaggaggcccttcagcgaggtgggcccagtgctgcccccttccccgcctctcccctgcccaggaccctgtctagcccacggtcctcccctcccgcctgtccttggctcttatccacacctttctctctgggatgccttgaagacccctggcccgagaggcagaccaatgttctcccaccccacaggtgacaaggaggagcaggaggtgtcttggtgagtcctccctgagggctggggccctgcgacggtccgccatctcttctcttcctggggcccagctcagctgcccaatcccctgggcctcacttccccagttttcgcactggattgtggaataacttcagagaattagaggccggcttggctggcctggggggtggggcaccctattctccacacctggccccctcagagccagctcccattcactgcaggacccagtacacacagagaaaattccagaagagccgccagccccgccccagctcccagtataaccagagactctttgggggagacatggagaagtttatccaggtactagctttgccccacatgccagcccacctgtacatgctgatctttcttcagctctgggtcacctcagtggccggagcagctgcctgatcccagggtcctccactctcaatcagtcatcaactgtccttttctgggtgggcctcttccaggccactgttgggctcccctatagcctccgctgattgaagggagcatccttaactagtaatgggaacgtatagaaaacctggggcagcggcatttttaggggcgagatattgagagcttctcccctgcgacttctggccagcatggtactgggggtcctggacagtgaaataaggggaagcaagaaagatcagaaaactaatactgagatcagaaagcatcagagggggccaggcacggtggctcacacctgtaatcccagctctttgggaggctgaggtgggcagatcccttcagcccaggtgttcgagaccagcctgggcaacatggtgaaaccccgtctctactaaaaatacaaaaattagccaggcatggtggcacgtgcctgtaatcccagtgaaagaaagaaagagagagagagagagggaaggaaagaaggaaggaaggaaaagagagagaaagaaaagaaaagaagcaagcaagcatcagagagggccaggcatggagaataccagaagatcagaactgatatcgtcattttcagtgatgtggttatgcgtgtagcatattcaaaagaatcaacagattctttaaacgagcactttgagtttctttctttttttttttttttttatttgttgagactggttcttgcactgttgcccaggctggagtgcagtggcacgatctcagctccctgcaaccttcacctcccacctgctggggttcaagcgattctcatgcctcagcctcccaagtagctgtgtgcaccatcacacctggctaatttttatatttttagtagaggtgaggtttcaccgtgttggtcaggttggtctcgaacttctgacctcaggtgatcctcctcccttggcctcccaaagtgctgggattacaggcatgagccaccacacccagcttgagttttgaaatgttacttgattcaagattggtgtacagaattcaattgcatttgtatattccagcaacaatttgcaaatacaacgtaaggcactgcctaaaacctcatcaaaaatatcagacacctacgagtggatctaacaaacggtgtgctaagcctctgtgccgacaacgatgatgtgttcttcagagaaaataaaagcactcagcctggtgcggtggctcatgcctgtaatcccaccattggggagcttgaggcaggagtatcacttgagcccaggaagctgaggctacagtgagccgagatcacgccagtgcacttcagcctgggtgacagagtgagaccttgtctcaaaaaaaaaaaaaaaaaaaaaaagcaattgaatgacaacacagggcatgctgtgtccatggtgaagtaaacaccctctgtccccagagctcaggccagcctgtgcccctggtggtggagagctgcattcgcttcatcaacctcaatggtaagcaggacccagcccctcccgatgtcctggcacccagcacccagttcccagcacctggcatgggaggccatcctggaggggctggggaagatgctcagtgcccaccagctccttgtcctcccacaggcctgcagcatgaaggcatcttccgggtatcgggtgcccagctccgggtctcagagatccgtgatgccttcgagagaggtggggacgggcagggcgggcgggggtgggggctcgggcagatgtcaccagcttcctccccctaccgcaccactcgcccatctgcaggggaggacccactggtggagggctgcactgcccatgacctggactcggtggccggggtgctgaagctctacttccggagcctggagcccccactcttccccccagacctgttcggcgagctgctggcttcttcgggtgaggctggggcctgaggctggcggggtagggcacttgctggggcagccccgctcacgcggctctctctgggcggctttggccacagagctggaggccacagcggagagggtggagcacgtgagccgcctgctgtggcggctgcccgcgccggtgctggtggttctgcgctacctcttcaccttcctcaaccagtgagtgctgcggggcgagtgctggggtgggggccaggggtcgaggggacagggggactcggggtgcgggctctctgcttgtgatgtgcgtgtccccccagcctggcccagtacagcgatgagaacatgatggacccctacaacctggccgtgtgcttcgggcccacgctgctaccggtgcccgctgggcaggacccggtggcgctgcagggccgggtgaaccagctggtgcagacgctcatagtgcagcccgatcgggtcttcccgcccctgacctcgctgcctggccccgtctacgagaagtgcatggcaccgccttccgccagctgcctggggtacacccttggtgctgccgaggggactggggggtccactggagaagagcccccctcatctgcctcgctctgccctgaacctcagggacgcccagctggagagcctgggggcggacaatgagccggagctggaagccgagatgcccgcacaggaggatggtgagggcgatgggcagagagccccaccctgtccccaccctagtgtccacaccccctcccacagcttggaccccctctcctccccagacctggagggggtcgtggaggctgtggcctgctttgcctacacgggccgcacagcccaggagctgagcttccggcggggggacgtactgcggctgcacgagagggcctcgagcgactggtggcggggggagcacaacggcatgcggggcctcatcccccacaagtatatcacgctgcccgccgggtgagtgagccgcgccctcaggccccagggctcccggagtctccccttcatccacccctcccccgaccccaagttagattctgaaggtctgggctgggccagagaacagagcctctctgaccactcctggctggcgcggagctgctggccctggaccccgtgcagggaaggagcactcgaaacaggccggtccttcccaccgcaggacggagaagcaggtggtgggcgcagggctgcagactgcaggggagtctgggagcagtcccgagggcctcctggcatcggagctggtccaccggtgagcaagaagacggggctcagggggccacacgtgtgctgttctaggccagaggggactggggtcaggctttggccagtgggagtgggaggagttggcagatgaggacgtgacagaatgacccagcttgtgacagggagaggctctagaggagcttggggaccactgggccagcctcctttccttggccacaccccaggatgggaggagccactgcccagctagctcagggacttcccagggcccccaccaggctccctgtctgtcctgcaggccagagccatgcacctcacctgaggccatgggaccctctggacacagacgacgctgcttggtcccagcctccccagagcaacacgtggaggtggataaggtgagagtgggtgtgtggcaggtgagggacatctgtcctgggggatctctgcctccccttggaagccaaactcctccctcctcgaggttccagtcgttgccctccctggccttagctcaagggaacctgccgccagacacacaggcccaaggcagagcctgtggagggcaggaaggcaaagatgtgagggcgggtggggatggagagggacggctacggaggcagggatgagagggacagaagacacctggcttgcacgttgggattcatgttcagcttcagagcagggagtggcagggctgagttaaggctgtttacctggtagaggcaagggactccagggcagattcaaggctggcatttgtagctgggctaggtaacaggcggtgccatggcaggcgcttggcacgccagggaggatgaaagggacagatggcagggaggcaggagggggtggctggttggggattggggtggggcagcagcggctctcgaaggagcagagcgaaggctcaagatgtggccctggcaagcgcacaacctgggggaccctgctccgtgctctgtaccatgggccctgtgaacactgtcgggctgaacgtggaagcccgcgggacagttgctaagcccaaggaggagagagcccaagaacatgcgggtgtcccaggtgtggccaagcccccaggcccagggagcccagggagggtccggtagacacggaggagcaggagcgggagccagggacagggcagccaggagacgccatgggaggacattgactggggagtccccgcacgctggcggtccctgaggccatgggcagggggctgtgatctctgccagggaaagagtgggggcgagaagaggggggtccccacttccgggctaaaccaaggaattgctgtcctcagaggagactgtgacagagacaccaacagggacaggagggatgccaggtgcaaagtgggggagagtgacctggaggctgagggactggggatgttggctgagggcttgctttgggagtgggaggaactcaggtgggtcttgggcagggtcagtcgggggaactcactggtcactctccctttctttcccctccgctaggctgtggcacagaacatggactctgtgtttaaggagctcttgggaaagacctctgtccgccagggccttgggccagcatctaccacctctcccagtcctgggccccgaagcccaaaggccccgcccagcagccgcctgggcaggaacaaaggcttctcccggggccctggggccccagcctcaccctcagcttcccacccccagggcctagacacgacccccaagccacactgaggtgccgctgctggagatgcgtgcccccggcggctacccgctggaccggccactctccccagcccccttgcttctctccagccctgtccagcaagtgcagggtgcctgcacttcaccctgtgcagagaggtgggatggggccgtgcacacagggatgcccgctccacatcctgcctgcccctcagccctggcccaggccccttttggaggcagctgaggaaggatgctggggaaagccctcttctgcagctttgtggaaggctgatcagtggctgctgggtggcgggtacccttgctcagatgcctggcagggctgggtggcgattcataaagacctcgtgttgattccccgatgggagccagctctctgtctcgggtgggcaggtgggtgctggaggtgagaacagcttccccaggggtcctgcagctttgaagacttggctgcctgcgccatggattccagagctgtgcacgtgactgtgggtgtgtgtggggagtctgtgtatgtctctgtgctgcctccacacccaccgttacccggatccaaggagaccccttgccatgtggaaaatgagctccaatttttattagggagagaatgaggagggagggattagaaaggcggagacaggaaggtcccctggccccagcctggtccttccttttcaggcccctgggaccgctgtctcacctgggggcacctgctccctctttcctgccactcctcaggcctctgctgcagcccctcctacacccagctcagtgagctgacctgaggggcccccacagtcctggggcctgaagctctcctcatacagctggggatgtggagacccaggcaggggctgtggcttgtccagggccacacagtgtcccagcctcggggccacaggctctggccaattctccacgggtccccctcccagtggctcccaggaccagccccaggaaggcagctgagcttctcaaagcctctagaggcaagacacccaacagctcctcacgatgaagtgtccttggccagggaggagctggcggtggtgcaggactcatcttggggacccaggctgggtggggtgcgtccccgggcacagcagagcaagcttcgcagctctgaggacacgctgctgctgaaagatgcatagatccaggggttggtgcagctgttgaggctggccagcaacatgagtagcacaaagggcgcccctgtggaggtggaggatctaggttgggttcaggatggctggtggggcacaggggcatgcggccaagcccaagtggccccgtcagccctagccacggctacacccaccttccagaggtgcctccgggtcccacgcggcccacagctgcaccaggaagaagggtgcccagcacagcacatagacgaccacaatcactagcgtcatcctcacagtcttggccacagctgctgacacgtgggctccctcaccggggctgcctgtccggcgtcccctgcggcgccccccaggcctctctgatggccctggcaccagactggcatgaatctcccggaagatgagcacctggcaggcggcgatacccagggtaggtgccacgaacaccatcagggcaatccaggtgacataggtgcgacggccccagggctccgcaaagcaggcccagcagtcagtgaccccgctgccaccttccacgttgcgctgggcgaagatgaagagctggggcaggctgagaaggagcgagaaggcccaagccactagcaccggccggttccagtgagccccacttccatggcggtacgccagcatgggacggcagatggcacggtggcggtccagcgtcatggccaggatcatgtaggaggaggcatacatgcccaccatctgcagatacttcacggcccgacacagggcatctggcccacggaagcggtcggtggccttccaggccagctggggcagcacttggaacagagccacggccaggtcggccaggcacaagtggccaatgaagacgtgtatgggtgcccagtggccccgccggccccgccgagctagggccgccagcaccaggccattgctcagggccacagccacaaagactatggagagcagcgccagctccgcccgggctagcagcgggtcccgggtgtccagtggcctctcctggctgctgttgctgggcaggctgggcagagagggatgcccaggcacagctgggaaggagtcgggaagagggcctggttagagagggtgctgtgcagggggactcaggcctgcctcccgtgcccccatccggacacccacttcctggctcctagcagaggggactccaggaaagccatgttatgagggatacacaccccaggctcatgcagtccagaaggaagggcagccccagccccagccccagccccagccctggcggggaagtggggctgtgctcccctccccactcattggcagcctggagagacacacccagaggtgagggtgaaggaggtctttagaaagaggggcttccctgaatcgtcaaacccactctgcccaccggactcatggaggggcaagccttaccggaagtggtggacgccatgagcatggtggggctggggcaggtgttctgagggcctggaggtgatgtgcggactcagcctctgcctgaggagcaagttcaatggcccagggtctctggactggagcccttatagagatgccagcatggcagatgcctgttggcgtgtgtgcacgtgtcggtggcagtatggccagtcctgggcagggaagattgagagggatggtcagacagacggatgcacagaacccaggatcccccaggcagcccatgagtcccgggtttgggagtgggcaccccagacagacacgcagaactcccctgccccaaccgaggccgagagaggccaccatccgagggctggggactgggcaggggggcaggcaggcgcagccccttacctggctgggctcctgggcagctgggcggtggcgtgaaggtggctgggtgctcagatctgctctccatcggctgccctgccctggcccagcccagcctctgggagtgacctggccaggaggggacttcctccccctccccctttcccccaggcctcccctggcctcctgtttcccttcctttccccagggcctccctggtcccggcccaggactccctcctcccactgccatagcctccacgcccaccctcaccctaccacgcccccctggttggattgtctgggttggcagtgctctgggaggtcacttagttcagcattcccattttataagtggggaaactgaggccagagagcggtgggtctggcccaggactgcgctgctttttcatgggagcttcacgcccccttcccaagttggggtcctcctgctcctcgctgggcccaggcaaggaaggggtgaaaacactttcgctgggcccctcccaggcccacgcaggcccctcctcctccccagttagggcccagttggccggagacgagggacaggaaagggaggagtggggcaggggccaagccaggcttcacgaacccctgtgagatccagggacacccccaccctcttcctcctgccccacctgcaactacctgtcctaggaagaggggctggggacctccgtgtgctcacgggctccctcccaccacacacaacctcacatgatacagccacacagccacaaacacacaacacagagacgctcgctcatgttcttgaacataccatgagtatggacgcaccttccctgtacctgagccctcctcctccctcccccaacacctctctccttcccctgtccccacaccccctccagcccccatcccagtagttctctttccactccccccgcacccaggcctggcttggctcagccgaggccagcccagcccagcccagcccaaggcagctgctttcttcctgtttgtctgtcttctctgttgcctgtgaagccagagaccaaaacagcctcacggaccaggcccaagtccggcccgcggccaaggcctcctcttcctgcccagagagcctggcagcaccctggcccctcccggccctgttagggtggtgggaacacagggtgggcattttccagagacagcgcacacaccacaccacatacatacatgcacacagccacacgccacacacacatgcacccaccacacacccatacgccacaccacacacacaccacaccatgcacacatatattacacaccacacacatgcacacatcacacactcccatacgccacacacccacacatgtacccaccacacagccatacacaccacatacgcacagccaacaccacacacgcacacacccgcagcacacacaggtgcacatcacaccccgcatctttgccatgtttttgcagagccccttgggggcaggctgcagagtgctggcaccccaggcctgacgcttcagctgcatctcctcagcgcatgcacatcctcatgctgtccccaataaccgcatgctgtcactaatctaggagcatagaaaaggccttcctaatgccacccagatcagtggaataggagatggcttccctcaactggcagagaatttggggaccctggctggggaataggaaagcaaggctccagcccctgcttggcccctgcccagtagtgtgaccttgaacaggccacgccagctcttggcacctcagcttccccttctgtgcaatgggacttgatgattgagggagactacggtggtaagatgggcaggggtggggactggcagggccttgggaaagcctttgttccctccgtctaaagccggctagggcgaggaatccatgctaaccttttggggtgagcagacaaccatctccttatcagtttctctgcctgaacgaggctgtgcagtgccggatctcagcagcaggttgggacctcccctagcaatgtggccaggcccgtggcaatctctgcccccctggactcctcgcttcctgttgttaaactagggaagaatctggaggaagggcccgcatggcggtctcctctgggatgcaagaagccagatcaggatccagtgccattctgctcagccaggaccccggggaggaactgggagccacatgggcaggcactacatggaactgtgccaggagagaggccctgggcagccacccctcgggggccaagaaagatggggctgggcagcagctcccatgggaagaagggcagactgtgctgattcacgctaggcccacatgagtcactcaagcccctgcccttgggcgttaacgggcagggcatctacctgggggtgtgccaggcccccactcctgccagcgcagcccctgtgtgcacacctcccactggtccctctaagacttgcagaaagggctctgtgagtgccaaggtgtggctcctgatcttccagcctagtgtctgggcagaagaggacaggaggcagattggggggacactgtttgtccctctctatctaccggttccccatgatcagaaccttccattcaccaaactgcaagtgccgctggcctagcactgtggctgcagagatggaaggacctgggctctgccccaggagcacatgggcttctgcagagaagagtggaggcagggaggctggtggaagctgtgcctgtcacccaggagagaaatggtgcgacccacttaacactgggcagcggggctagagggagcaggcaggtggaaaaggcatttaaagggccctgaaggatttgtaaggggtggaagacaaagaggaggcagccaaggacgaggagaaagaggcccccgattgtgtgggaggggtgcatgtgcagatggtggagcctgtgggcagtgggaaggacggagccaagtgcctgtcaacaggaacggccctcacagggactgtgacccgaaggagaatacctagagcccaggagatagggaggaacaacgggttggaggatgggattgaaggggacaaaaacaaatttaataaaaactcaagtgtacttgtgtgaatgtgagggtgtgtgtgagggtgtgcgtgtgtgagggtgtgagagtgtgtgagggtgtgtgtgagagtgtgcgtatgtgagggtgggcgtgtgtgtggggtgtgtgtggtgtgtggtgtgtgagggtgtgcatgtgagggtgtgtggtgtgtgtgtggcgtgggtggttgtgtgtgagggtgtgtggtgtgtgtgtgtgtggcgttgggggggttgtgtgtgagggtgtgcgcgtgtgtgagggtgtgtgcgtgtgtgagggtgtgtgcgtgtgtgagggtgtgtgcgtgtgccaatgatgacaggaagacagcctgcggatgatcatctaattgtgtccattcacctaagtgaataataactgggaaagctggacagagcctgtttatagctgcggaaaggcagcccatggaactggatagattaagagcctcgcggagtggaagggagggccagggtctccagcaggtgctggggtgaggggcggggggtagaaggagggtgagcgttgagggcttgagggccgtacccatagatggcctccaggtcatcatgtgagagtcaggcaggaggcggctccctggcaaaactgcagagattttttttttttttcttttttaaaggcagtggcccctcccgctttcctccccagaggcggccgactgcagttgctgttagtgggctgtttgggtaactgcctcggggtttcccagtctgacttcctcttgctctctctgcctgcacgttcctcccccagattattgcagcagctgctccgggtgtcttcagtgctcatgcactcaccaccctggaatggccctccgcaggcaatgatttctctcctccagaatgacttttttttttttcggctttattgaggtatgattagcatacagtaaaattcattaattgtaattgtactgttcagtaagatttgacaaatgtatacagtcgtgtaaccacaaccacaatcatgacatagaataaatattttcgacattccagaaagttccctcgtggccttttgcagtcaagcttcttcccctacctgaaagcctagcaaccactgatctatcactatagattttccttttctagaattttatataaatagaatcatagagtatgtagtattttcaaaaattagccgggcgtggtggcgcaagcctgtaatcccagctactcagaggctgaggctggagaatcgcttgaacccgggaggcggaggtttcagtgagccgagatcttgccattgcactccagcctgggtgacacagcaagactccgtctcaaaaaaaaataataataaaaataaataaataaataaaagagtacatagtattttgtgtaacttcttttttttttttatattttttttggtggggaggaggcatagtctctcactctgtcacccggtatactgaaagcttttatcacaagtgagtattgaatttttttcttttttttctttttttttttgagtcggagtttcactcttgttgcccaggctgcagtgcaatggcgagatcttggctcactgcaaccttcgcctcccaggttcaagagattctcttgcctcagcctcccaagtagctgggattacaggcaagcgccaccatgcccagctaattttgtacttttagtagagacggggtttcttcatgttggtcaggctggtctcgaattcccgacctcaggtgatccacctgcctcggcctcccaaagtgctgggattacaggcatgagccaccacacccggccaatttttgtgtttttagtagagacagggtttcatcatgttaaccaggatggtctcgatctcttgacctctgatccacccaccttggcctcccaaagtgctgggatgacaggtgtgagccactgtgcctggctgttgtttaccatttttacatctgtattaatgagagatgctggtctacgttttccctttctgtaatatctttggtttggggatgagtataatgctgactttataaaacgagttgggaagtgttctctctttttctgttttctggaagagttagtatagaattggtattatttacacaaacctggagttttctttgtgagaattttttcagttataaattcaactcttctgacagatacagggctaatcaggttatctattttttcctaaatgagcgttgaccatttgtatctttcaaggaatttgtccatttcatctaagttgttggatgtattggaataagtttttcacaacatcctcttatcacttttttatgtttgtaggatctgtaataatgccccctctctcttattctccatattggtaatttgtatcttctctccattttttttttctgatcagtctggctagaggcttatcaatttcattgatctttttgttttgttttgttttgaaacgaagttttgctcttgttgcccaggctggagtgcagtggtgtgatcttggctcactgcaacttctgcctcccagattcaagcaattcttctgcctcagcctcctgagtagctgggattacaggtgcacaccaccacgcccagctaatttttgtattttttagtagagatggggtttcaccatgttggtcaggatcatctcgatctcttgacctcatgatctgcctgcctcggcctcccaaagtgctgggattacaggtgtgagccaccgtgaccggctctagtttcttaaagtagaaatttaaataattattttgggacctttctgcttttctaatataagtagttccttttcctctaatcagttgttttgttgaattcccaaattttcatattttatttgcatttctattcagtgaaagatatgttctaccaataattttacttgtggtttcttctttggttcttgggttatttggaagtagatattttttcatttcaaaatatttagaaaattcctagatgtctttttgttgttgatttctaattcaacatcattttggtcagaaatcgtactttgtatgattttgaccctttgtaatttattgaggcttgctcgattgcccagaagttgtctgtgttggttggggttccatctgcacttgagaagaatatgtgttctgctgttgttggatgtagtgttccgtacatatcaattgagtcaattaggttgatagtgttgttcaaatctatattcttctgatttttttcctatttgttttatcatttactgagaaaggaatgttaaagttggccagtatgtttggagatttatctgtatctagaaccctttagtcctataaattttgtttcatatatttggtagattaggtgcttatatatttgaaatggttgtgttttcttgattatgtgttcttttttcattatgacatgtctctcttgatctctagtaaactctttgtcttgaattctgctctacctgatattagtatgatgccatggcagctttcttatgctcagtggttgcttggtatatctttttccatacttctactctcaacatgtctgtgtctttatgcttcaaatgtgcttcttgtaaataacatatagctattttatctagcccaacagtctctgccttttaactggtgtgtgtggcagattgtgtttttcaaaggtagccccaacaatatctcccatcccacatgctctcctggaaccttgccacttccccatcaagaggtggaatttaaccctcccccctataatctgggcaggcttgtgactttcttgtactcaagataatatggtaaaagtggtgctgattgatttctgaggctagtgcagaaaaggtaatgcagcttctgccttgttaacagggacactcactcttcaagcctttagccaccatgtaagcattccaacttccctgatgctataaggaagcccaattcagccatcatggaaggaccacagaaaatggctctgaggccaggcacagtaactcacacgtgtaatcccaacactttgggaggctgaggtgggtggatcaagaggtcaggagatagagaccagcctgaccaacatggtgaaaccctgtctctactgaaaaacacaaaaattagctgggtgtgctggcgtgcgcctgtaatcccagctactcgggaggctgaggcaggagaatggcttgaacccgggaggcggaggttgcagtgagctgagaccccgccactgcactccagcctgggcaacaaagtgagacaccttctcaaaaaaaaaaaaaaaaaaaaggctctgaggcaatatgaagagggccaccatctgacagccaccacatgaaagacctgggccaggactgcccaggtgagcccttcccaaattcctttttttttttttttttaaggcagggtctcactctgtcagccaggctggagtgcagtggcatgatcacggctcactgcagcctcgacctcccgggctcaagggatcctcccatctcagcctcctgagtagctgggactatagacatgtaccaccatacccagctaattgttgtatttttatagagacagggtctttccatgttgcccaggctgttctcaaactcctgggctcaagcaatcctcccacttcagcctcccaaagtactgggattacaggtgtgagccaccacacctggcctatttctattttaagaagtaaataatcatatatatttatccctcctggggtaaatatatgtaatagaacagtggggaagatacacataaaattatgccccaaaaagggcatgacccttcttgtcaggccattagtgtgtgcatgcgtgtgtgtgtattagaggctggtgtgtagttaagtggagtctggggtttcttgttgctttgcgtagactcagttttctgtatacttcgaatgatttcagagcaggatcagaacattctctttggtgggacttgtgatctgagtggctgggagtttctttgattctcctgcctcacccgtagacttcagcagatccctgagcgcacattcccgggtgcctattgtaggtcttttgcctccactccaaccacagttcgcttctggtttgtactcagtgtaaggattagaatcaaccggaaggtttgtttcagttcttctgtcctgccttaagacttcctagagcctggggatgaactcttcagtcctcctgccctgcttcattcaccagttacagctgctctgtactcagtggaaggtcaggagccccaggggggttcctgtcggttcccttgtcctgcatccagacttcagcagcctgagcacatgtctacctcggagagtatctttcggcccacctgctttgccttcaaactttcttggtgaaggcccatgcaaaagagttagtgggtgaatgtaagctctcttgaatgggaggcattagagagtctatagcctcatgccgtcgcacactcagccttttaaaatgtgttcagagtttctctgtttcttttgtacacaagtctgtggcagcctcctcttcctgctgctgctgtgccaaaaatcaaagcagctatggggctcttttctcctagaaagggcttttcaagattttgattttttttccccccaacctcagcttcccgatagccttaaaagaaaaaaaatcctatgatttgtaggttatccagcttcttgtagctaggatgggagtgatgttgtcttgcaactttctgtattttgttagaagaaaaatatccatctattgaatttttcatgtatgcttccacaaaaaactcttgtttgttcgctgaatgttccttttttatagcatcctattcttgattcatggatatttttacattctattatctccctgagtgagttaatagctttaaaaattctttttaaaaaaatttttttatgagacagattctcgctctgtcgcccaggctggagtgccatggcacaatctcagctcaccgcaagccccgcctcctgggttcaagcaattctcctgcctcggctttctgagtagcttggattacaggcatgcgccaccacgcccagctaatttttgtattttttggtagagacggggtttcaccatgttggtcaggctggtctcaaactcctggccttgtgatctgcccccctcggcctcccaaaatgctgggattacaggcgtgagccaccgtgcccagcctagttttaaaaattattacctctcatagtcgtgtttcccaacaattgttttcctgtttgttttgattttgatctttcctgctttcatgctaaaggttttcctcaggtgtctggtgatccttggttgtcttctcatatttaagaatggggcaggctgggcatggcagctcatgcctgtaatcccaacactttgggaggccgaagtgggcggatcacctgaggtcaagagatcaagtccatcctggccaacatggtgaaaccctgtttgtactaaaaatacaaaaattagctgggcatggtggtacgcacctgtagtcccagctacttgggagcctgaggcaggagaatcgcttgaatccgggaggtggagattgcagtgagccgagattgtgccactgcactccagcctgggcaacaagagcgaaactctgtctcaaaaaaaaaaaaaaaaaaagaatggggcactaatgagctgattgaaaaggaaggacatgtcaactatgagcttcatcataggatgatgtagcggggctggttttattggagaaccccaattttactaccttttcgttcaccttgggatggccaaatacccagagatagatctttagcctgctgcctgaggctggttgtcagcacttgagaaacagagtgggccaggagggtccaaagtggtccaaattcagtaggtaaatatttatttaaccccctcatttttagtatggtgccatctaagctgttcctggtactccccacttgaaacactctttgtttcatcatctccaaagaataaacattctgttccgttgggatggggaaaagcatgtggagatctgactgcctcttcaacagacttttaatggcacttccatactcacccccattttctggatgcgtgtgggttccgcagtgaaattcagctcccatgattttgctgctgttttctattttcccattatttctgtccttgggagtttttctttttaaaaagtcatttactgtcattttggtgggatttcatgaggaagagaaagtgaatgtatgtgcttaatctgtcactttctcctttcttccttccttccttttctttcttttctttctttctttctgatggagtcttgctctgttgcccaggatgcagtgtagtggcatgatctcggctcactgcaacctccgcctcctgggttcaactggttttcctgcctcagtctcccgagtagctgggattacaggtgccccatcatgcccggctaatttttttttttttaaacttttagtagagacagggtttcaccttgttggacaggctggtctcgaactcctgacctcaagtgacccgcccgccttggtctcccaaggtgctgggattacaggcatcagccactgcacccagccggtgcactgcgtggaagggaagcagggctggctaagggcatgtgacaggattgtgatattcatgggcagcttgtttggagcccataagtccctagggataccagtctacacagtaacatgatcacctccaggctgtgaggaggagtggtgaaggcaaacaagcaattcttttcaaagcatggggtttcgtgggcctagtataaagaaaaacaagggaatgcatgacttcagtgtggttagataggagaggtcgagcaagatgcccaccaagacatactccctgctgcagcagcaccactagccagtgacttacccattggtggtgtcttagtcagctccagctgccatcacaaaataccacagactgggtggcttaaacaatggaaatttatcttctcacaattctggaggttggaagtcccagatcaaggtctggcagggtccacttctggtgagggctgtcttcctggtttagagacagccaccttctcactgtgtcctcacatggtaggggcagtggtggaggggagggaacagtgcttttcttgtgttctttttctttctctctttcttttctttctctttctttctttctttctttctctttctttctttccttctttctctttctttctttctttctttctttctttctttctttctttcttctttccttctctctctttctttcttttcttttgaggcagggtcttactctgtcacccaggttggagtgcagtggtgcaatctcggctcactacagcctccccaccaaggctcaagtgattctcccacctcagcctcccgagtaacggactacaggcgtgtgtcactatgcctggctaattttttgtattttttgtagagatggggtttcaccatgtggcccaggctagtctcaaactcctggactcaggtgatctgcccaccttggtctcccaaagtgctgggattataggcatgagccatcatgtccagcctctctgttcttctttatctgctccatctgggggttaggacttcaacgtgcgaattttgggggtacacacacattaagtccataacagatggccatactgcctatcacacagcttgaaccaaccttggcctcagctgcctggaccaggagcccgcacctggccaagactagctagtccataggctggttagttgcctacgaagttacctggcatgaaggctccaccaaaatgaggataatgagtatttgggcccataagtttctctctcttggaattgaaactgcagtgagattagaagccaaaagacatgtgcagaaaaagccacgggtatttgtcacaaagcaggagaatgccaggagaagcaaagacatgaagaaaagatggacacagaggagaggggacagcagctggtgggtagtgacaggcaccgtgggggctacagcaccataatagcagttcaggggtgggagtgtgggggtgtgggtaagtccctagagctactgaaaaccaggcttcccaaagctcagacggctgactctgcctgggttcctgtccacatatctgagctcactgccttcctcattcctacatgataatagggcccacctcatgtggctagtatgttatcccaggccgtgcattgtgtaggaggagggaagatgtattagtgatctgtggctgcaaaccaaatcacccccaaatgcagtagttcaaaatgacagtaaccatttattatctcataatctctgtgggtcaggattcaggagtggcttagctggattgttctagctcaaaggctcttgtgaggctgcagtgggattctggccatgactgcagtcatgcaaaggcttggctggggctggaggatccttttcaaaatggcacactcatggttgttggcggaagacctttgtttctctccatgtgagctcctccatagggctgttgagtgtcctcacgatgtggcacctggcttcacccaacagagcaatccgagagagagagagagagagagagagagagaaaacaaggaggaagcagcagtgcctgtgtgacctagtccccacagctgcagccattgcttccgctttattcttttcatcagaagtgagccaggtgtggtggtgtgtgcctgtggtcccagctcctgaggaggctgaggcgggaggatcacttgagcccagaagttcgaggccgcaatgagctatgaacatgccacagcactccagcctgagtgacagagcaggacctcaacttctaaaataaaatttaaaaaagaaatgaggccgggcacagtggctcaagcctgaaattccagcactttgtgaggctgaggcgggcggatcacctgaggtcaggagttcgagaccagcctggccaacgtgatgaaacctcgtatctactaaaaatacaaaaattagctgggcgtgctggtgggggcttgtaatctcagctacttggggggctgaggcaggagaatcgcttgaacccaggaggtggaggttgcagtgagccgagatcacgccactgcatgccagcctgggcaacagagtgaaactccatctcaaaaaaaaaaaaaaaaaagtggtggctcacacacctgtaatcccagcactttgggaggccgaggtaggtggatcacttgaggtcaggagttcgagaccagactgaccaacatggtgaaaccccatctctactaaaaatacaaaaattagttgggcgtggtggcccacgcctgcaatcccagctacttgggaggctgaggcaggagaattgcttgaacccaggaggtggaggttgcagcaagctgggatcacaccattgcactccagcctgggcaacaggagcgaaactccatctcaaaaaaaaaaaaaaaaaagtgagccaccaagtccagcctatactcaagaggaggagaattaagcactaccttttgaaggcaggagtatcaaataatttatggacctacattaaaaccaccagagcagaggtattagttaactttagactttattaagaatgcatgttaaaataggtagaggaactactaaaaaattcatagagcacttctaaacaaacagaggagaaaatagaatgagagaacaaatccagtccatctaaaagatgaccaagagcagagcatctgcctgggcatattgacagctctcggcactcactcccaccttgtgggctctgcatggcagaggctggaaatgttccagactccagagcagctggactttgggaagcaaatttagttttgccaattggcaaattggcaaatttgccaattgccaaattgggtgtgctcacatgaagtttggatgactgaaggaagggaagccacacttctgctgtgtggggctgcgtttctgctggacatcaaagaatttctggggtctaaccttcacttcttggttgttgaggggcacttgtggcagcaatggcttcctggtcccagcttgctgatcctcaggtcatgactttggtggtgtctttttgaactcaaaggttacactggccgcctcccaatcccccatcttgtggatggtggcagaggtagcagctcccttgaggagccaggtctgcactggtgttatcaacacctagcccagagtccactcctttggcccatccaatggtcaggtaagcatctaatcccttctacagaatccctttctgttcatgatcacgggaggaatttctgcttcctaccctgaacctttgagaggtgaagccagctagacttcctgggtgatgtggggacttggagaacttttctgtctagctagaggattgtaaacacaccaatcagcgctctgtgtctagctaaaggattgtaaatgcaccaatcagcagtctgtaaaaacgcaccagttttctgtgtctagctagaggattgtaaatggaccaatcagcactctgtaaaatggaccaatcagcactctgtaaaatggactaatcagcaggacatgggaggggacaaataagggaataaaagctggcccccccccgccccccacaagcaacggcaacctgcttgggtcctcttccatgctgtggaagctttgttctttcactcttcacaatacatcttgctgctgctcacactttgggtctgtgccacctttaagagctgtaacactcaccgcgaaggtccgcggcttcattcttgaagtcagcgagaccaagaacccactggaaggaaccaactccagacacaccttcactgatacaatgtgggggtgaggccaggtgcagtgactcactcctgtaatcctagcactttgtgaggccaaggcagtggatcaccacttgagcccaggagttcaagaccagtctggacaacatagtgagacctcacctctaccaaaaaagaaaaaaaaattaatcaagtgtggtggtggcacatctgttgtcccagtacttgggaggctgtggtgggaggatcacttgagcccaggaggtcgaggttgcagtgagccatgatcacaccactgcactccagcctagggaacagagtgagaccctgtctcaaagtaataacaacactaataaaaaataataaagtggaggtgggggagagagatggggaaagcaggacaaatagaaagcaaatactcacctggcgtgactacatccagagatagcagcagtcatcaccgtgtgaccagctgacctgcacagttcaaagacaaaggcaggttcaacatcaatctaccacttgactgaacaatccactcctaagcggttaccttagagaaatgaagacacacatttacacaagcttgcatataaatgtttagagctgctccatcataatcacacaaagctggaaactacccaagtgtccttcagtgagtgaatggctgaacaaaccctgatccaaccaaacaatggaatactactcggcaatcaaaaggaaatatactgctctctctcgcccgcatgctctctctctctctctctcacacacacacacaaacacacacaccaacatggatgaagctcaaaaagtatgctgcgtgagtgtgaaagaagccagacaaaagaatatatacggtatgattccatttataataaaatttagaaaagacagaaatcagatcagtggtggccaagggcagggggtggtgggagtggttggctgcacacaacattcaccaaaactccttgaactgtaaacctcaaaaggatgaattttactgtatgtaaattatactccaataaagttgatttttttttttttttttttgagacagggtctcactctgtcacccaggctggagtgtagtggtgtgatcatggctcactgtagcctcaacctcttgggctccagcgatcctcccacctcagcctcctgagtagttgggactacagacatgcaccaccatgcctaattttaaaattttttttgtagagacgtggtctcgctgtgttgcccaggcaggtctcaaagctgatttttaaaaagacaagaattgttagacagaatcaaaccaaaccaaaacccaactatgtgctgtttccaagcgctacacctgagatatgaagacacagaaagattgaaaggagaacagagaaagacacgtctggctgagcccaccccgcctgcctgctggcacttccttactgccccactgtcgtctgtggcttctgcgtcttctgcatgctcatcacagggtcagagtctggggcttcccttgtccagtccactgtgtctatgagggctgggtcacagggagcagggctgtgagaagcacttgacgttgaagggaaagagacagtcatctgtctacttggtgtccccctaacctccaacagcaagcacatggcagtgggggggtggcttgcctcttgttcagggccagtccctcctgcttctcctgggacttgctctgcccttggtcttctgtcactcttgctcttgctcccattggctcctccacttcattacatggaagtgagaatgggcatcgtggtcaagcagaagggaattcaagtccgagttctgccatttaccttctgggctatcttgggtgggtcatttgacccctctgaaccttggtttcctcatctgtgaaatgggggcactgatagtgccaatttcttcctggttgcatgactgcccctctctggaccttgggtacctcactgggagagtgaggataataacagcaccatcatctggggtgtgtgtgtggatgcaatgagccagtggagagaaagagaccttcctaactgtgcttgctggacccagccttgagctctgtgggctttggttttctcatctgtaacgtggggcgaatgcttcaacagacctccccaggttggtgtgcaatttaaatgtgcaggaaatgtaacgatggcaggtccatggctgtgctcaggaaatgtgatgtcgtgtaatcctagtaatgaattttttgttaccataaatggacccatcactacacattagcaggtgcgtataaacgggctctattccctgcttacttcaccatcctgatgggcatcaaaccctagattaggtaaaggatttgcagaagttggggcttggaggaaaggctgggaacgtagggagtgagtggaggcagcaactggaaaggagagaggcctatcagagttcagatcagcaaaggcaggaagctgaccacagctcagtgcctcatggaaagtacgccctcttggcccagctcatgagcctgctggcctcgtgacccaggcgggctcagtttcctctgctgtcacctgaagatgccctgcaagtgcccccactctggaagcagtctccctagccgtccgtcttcactcaggtgcctagtcttgtccattctcctcctaaaggctgggcaaacatggcatccagaccctctctgagcacagatgggtccaccccaagcttcccattccaggggaactgaagctggcactatgggggtggggcatccaagccaggatgccagggctgctcccatgtgggccctccagggccccacaccacttggggagtcttgtgagactgagtcgagggcccctggaatgcttcactgggcaacaggcatgcccataaaaataccgtggccgccagatctgcaatctgccatcggggccctaggccttcctagccctgaggctgcagccagctcgccggctccggaattcttaccccctccattttgcttcctcgcctgtgaggtcatggccttgagcctaggagggggcactggggaggagctccttccttctcgatcctgtgcagggctgcgggggagagtgggagagagtggagtcggcgggaaaggtcgaatggggccaatcccgaggacaaagaaataagacaccagagagctggaggaaaatctgggagttgggggtggcagttcgagggataccctctcccagaccctgtctcccctgggctcgcctcctaccctgccgcccacctgggctctggggtgcgcaggagccggtgctccgcggcgcctccccaacacgctgaggacgaagcccccgcacccctcccaacaggaccctgactgggccctcaggatcggggggcattcgggagaggtcccgggagtcctgccctgtgtgtgtgtgttgggggggcgttgcgtgcaggtgcccatcgctggccggcgccgtcgagggccaggccgaggctaagggagcatccccttccttgccggactcctctctccaccgcccggccccaggcctctgggagcactctcgccccgcgattcccgctccgagctttcacagcgggctcccttgcgctggggctgaggacactctccggccggagactcccggtctgcggggaagggggtctggcgggacccgtcggctggggtcccgctgagctcccggagtgggctgcccgggggcccccagcccaagccgcgctcggctggcaccaggggctagggtgcggcggggcggggcggggcggggcgggcggccggggaggtgatctcactcctccctccctctcctccccggcgctcccctcccccgcccctgcgcgcacgcccgccccgccccgccacagccgctgctgccgcagcatcggcatcgcagacgcgctcgggcggcgggtccgaggccggcgtgcgcggaggctgggcgggcagcccgagcggtggccgcagcgcaggtaaggcgggctggcctccccgtgcgacccgggccgcggccgcgatcccccggcgacaccacaccgctctgcccggggtgcacggaccagggagtcccggcccggtccggcccgcggtaaccggcgttgctgccggagccccacccatgccgggcgtcgggctccgggcaccgcgggctgtaagcggggcgggggagggatgccgggtgcccgagcccgacaggtgaggggtaacctgcggggccccagatgctggcctgggcgggagaacagggcggggggcgtcaggcagggtctgtgtgggcaggcgggggctgaagttggcgggtccccgtgcgtgtgtgcgtgtctgagaaaggaagccagatcgggtcgagcgctcccccacaggccgccgtggggtgtggccctgggcgtggctgcccctcatccccagccgagagctcagtttggttgaaaatcccggctgacagcgtggtgaggggtagatcgggataagccgcccctgcaatggggggaggggagtgaacgggactgggcgctgcctgcccctccgccccaaggttgggggggctttgttctcctccttcttctttccaaatcccagcctgggctcctccgggctcacccgaaaacctgccgcagagccaggggctcctccccggaggcgtagggcgcctctggagcccgtttccacaggctctgtggccagtcagggctggagtgggtgaggtcggttcgggcacccactgctgtgcctcccgtgcatgggtgtccatcaggtagggtccatcaggtaggggtgagggaaggtgggcctcactggctcaggcggtccctgcgcactgcaggtcttttgcccactgccacatcttcctatctctgtgcggttatgggaggggtcagcgattcctattccctccattccaggtcagacttttggggcctcttggttggcagggattgcaaagaacacgcactacaatccattgcccccgacagggtatctggaccccccacctatcactgtccctctcaggaaggcaggcctagagccatctgcccccttctccagaaggagtgggggcctggcaccccccaggtagataccctgcccctgttaaccccaccctgagggcaggggcatcggggcagcccagtgccatctctgctgactcatgtggccctgacgtaaatcagtgcagtccgcccttcttcccctgggggctgctgcccagcatcatctttctggggcgggggcctccccagggcctctcccctcccgtcagctccttgctgcaggtggtgggacttggcccagcctggcctctcccctggcacagctcccatgcagtgcccacatgtgcacacctgagggctccagagcctttgaggactcggctgtcttggccacatgggaagtttggggcagggttgggcctgggaccttcccacctccttggctcctggtcatttctctctgctgcatctgagtctctctccatatttattgatgtttgtgtgtgtatgatcccgaaagtaatacatcttattgtaggacacttgaaatatacagaaaagaacaaaagaaattaagaatcgctagtgatctgatcaccaagagggaaacacgttcagcacgccccagcctccctggtttgctacaccgcgctcctaaaaggctcctccccaagttcccagctgccagctccctgctgagcatcaggaggacaatcagcgcttcaaggtggcggggtcccctgccctgcagccagtgaagagcttccctacccaggcgctcaggatcccacgatgggcagtcgtgtactgggcagctgctcatggccagtgctcctttgggccgggctctgggctgcccatggaagagccagtgacaaactggaccagcattgtccctgtcttcgtggggtgtcacttgttttcttttttcttgatgattatctgaagggaaaagggaggcaaagagtgaggaagggcctggcctgagggctcctacagtgagcagggtgcccagattgtgcccccaatcggcctctcccaggtccgagccctttccaccactggaactacagctggcgccttccttggcatgcacctggccaggactggcaggtgagggtcgaggagacaggcctgtgtgccctaccttgatcaccaagttccctttcaaagctcgaaatggctgcactgagtgcttttctgggtgtgagggtgatgcggcctcgcagagtggcccaggctccaggagggcacgttcatgggagaacctggggtagtggtggggtcctgtgaggaggtctgccaggatggggatcccagccaagaccctggtctgccaggcatgagtgggggcatgagtgggggccctgcctccctccctcgtggttcagacagtgggggaggcggggggtctggatgcccttctagggtccccagcagggtgctcattgccctgtcctctgcccctgcaatgggctggggctgggtccctgggtggggccatctggaatgggcctgcagcatccctgcccctgcagtcgctgtcttacttgctctgatctggcccatctcggacacctccttctcctgcttcccccgcccccctgctctctcctctgcagcctcccacgtctccctgtgccccacccccagggccatcaccttcctcctccttctaggcagaagcctgctgctgccggggatggggtgcaccactccccgtctcctccctctgcctctgcctgcctggccctcccttccctcttcccccttcccgtcagggctctgctccatctctctgcttacccttttgtctgtcttccaccgctctgctcctctccttgtcccccccagctgcccctgcctcacccttgagggccctgaggttgtgccctgtccagcagccactcagcacccttctgctggactctacgccttggggttgggcccagaccccccatgggggccttgtctgagtggaaggctgtatggggggtgcctggtgagcagcagccagacgagcactgggggaggtagcccgcccagcttgcctcttccccagatatcaacagggtctttgtggcttcctgaaggctgtggctggaaaaagagggaggagctggggagggtctggccgctgttctttctagaagcttttctttgtccagtggcccccagcccaggtccccgtgttcttcccaggttggaaagctgcagagggagtgcccagccactgtcagtcagcagctcctgctcatctctggcccttacacccagcaggggcagctgcgagggccaggggttgggtggggcaggagggtggcagcgtcctgggctccatgcacttggccaaagaggacttctgaacccgtccatcccagtgcgggtctgagagtggaacttgagggaaagggactgagtcccgggagcccctctgccccctgccctccagccaggcagacttcctatctgcatgtatggggtttgtgtctctgcttgtgtgtgtgtatttgtgtgtgtgtaacctccagtattcctgtttgtctgggtggggtcatatatttggttgcatgtgtgtgtgtgttcgtgaaccagcatgcacacacatattgtcatgaggccacgtgggtctcctcagatgccccaacagggcctgtgctgggaaggggtggggctgagggtggctgctgcagtggctggatggggacagagcctctggccaacccaggctgtgcttcagtggaggggggttccctgtggccctgtctcccagccatctgcgtctgtgttcatgacttaggaatgcccaagccctggggatcacagaggccccattgtccgcccccgggcttcctgtgtccccctctgccctttaacccctcgggagtggggcccctggagggggcccgtggggcctggcagtgtctgagctgtttccaggcacccccaccccgccccccgcaaaccaacacaggctaggtatcccaggactgctgtgggccagggcctctccctgccccaggctgggctccttccctgctctccttttcaggccacagccccaggaactggatgcagtctgttccttctggcctggccgctgaagccccctctagtgctagggtcatcctagctccctgaggaggcctggggcctgagaggagccctagttttgctgccacctcatttctctcgccttctaggggtctcggaggctgaagccttgccgcctgctgggcatcagtatctccttcgacacaagaatggggccactgctgtccctaaatgctgattggagaggggcctctttgggaggggttctggagcctctggttgcaagaaaggtatcagaacaagtccagattccagagagcagaagaggggaccaagaaaccagcctgtccccaagcccaaaagggaaaggagttggccttctcttggactgagtacctggatgggggacttgggggtttgtttggtgtcgggcttcagctctgtgctgagacgtgatgttgatcacatcctacttccgcatggcctccatcccaagatgtcactccctgcccccgacatttgcctgccatctgcctggcaagtaagccctccccacggggcaggatggcttggaggccatcctcgcccaggcccctggttccctgggaagcccagcaggcacacatgttgggatgccagagcctctgagaggcagcttagggagccaccacgccctctaaaaccccacccctgctgagacccagtgccagctctgtgatcttggacacagtttccagttttctgagcctccgtgtcctcatctgtaaaatggggatgatgatagcacctccctccctgaggcaaatctggggaggagatgagtggatgtgagtggaagtgctcatgaggctttctggtacgtggtaagtccacgctgtaagttgatttaatagaacagaccacagaggcatgtgattgtggggatggagtggggctcctccctcccttccccagtagtcaagaccgtcctccctgaaccccacaaagggttaacctccgtctcttttccccatcttttaaggagaatggtccattacaggtgagttgtagttgccttggagactgaagcctcaggcgagatgagggggctgagggctcactctctcctaagggtaccctcttagggaggggtgaggttgggagtgcagggactaagcagcagtcataaaggacttctgggcccccaggtacctgtgggggctccctggagcagccccctttatgtgctgtctacataacacataacaaggctttcctctggcttcccccacctctgggacttgggctgcatcaccatagaaacccgccagccacggcctggggagcggggcggggagggccagcgggagccttaaagggacacagtgcacagggtgtaggtgacacccacaccatcgtatacacaccaacaggcacagaagccccccaggctcccaggcctgcaagcacatgggcccagcaccacactctgaccctttcatgtgccctgtgctgagcccccagccccacccccactctggcccactgagtcaccaggcaccatgtccccaggagacaagggcaggagaagccggatagtctctgctgtgctgttgaagggctctcttgttgcttctcctttgagaggaactccaggcagaacctgagaactgacaggcaggtgtgcagggcacatgtgcagggcaccgctggaggttcccttctcaaggtgtgtggtggtggtggtgatggggtgtgtgtgtgtgttttcagggaggaggcagtcactccaggtctagccaggctccacaacctcccaggtccctccctggcaagctgcttcccatcagaccaaagcaggcactttggagcagaggacagaggactccctgagggacctgcgggtgtagtgggaggccaggtggggtgggatggggcaaggctcttctggggctgaacccctccctgtaggctgctgggcgtgacccttgcctccctggccctttcccaccggggaggatgggtttgggaccggacttactcaggaatggccccatcttcaactgccccagcacagcggccactgtccactcagtgcatggtcacgcaggctcactcttggcctaacacatgtgcgtctcctccagccaggtgaccacttactcccagccagcagcaatattggaaggcttccctgggattttctgggtgcttccccctccccccgttcctacccgcagcaggaatcccccgacccccacctgttccctggcatggcatgggtcagccagcagtgtgccattcatcctgtctcacggccgtcccttgcccagtgccacaagtgggcagggccttgatgctctgttgcgtggggctttgtaggcccctccggccccagctcacagctgctccaccctctgtctgtctctctaccctgctcccaggccagcgtgacgtccacgccgggaagcccctccactgacccaggcccatcttccctcctccccgccccttgcctggcacagcccccagggacaaggacgctgtgcaggcggcctgcgcgcacgcgcacgtgcacacgcccacccccacccctcactcttctcgctctttctgccatttctcagcggcgcactctgcagctgcctctcaccctttgtgctccggtttcctcttctctccctttctctgctgcctgggtctccgtttcggaatttccccaccccctaaccatctccatcgtggttagcgctgtcttcctacgtctgtctttgtctcctgctcccccctgcctcttctcactctgtctgtcacccttggcagacccggccttggctccatctgtggaacactcccccctccccgctcctttgcccttagtggtgctggtggggggtagagggcctgctgagctgacaaccctagctgcttgctctgtaattgcctgaggaatggtgagagatcagagacccagcagcagtgggaggagaggagggagcgccccctcccagctgttatatctcgcaaccttctggctgcttcctgcctgtctccgactgcccagggcggtggcaagctaggtggcaaatactgggagaccaaaaaagaagttggatatgagcctgtggggagatgggatggggctgggatggggcagggagcggggaccaggggtttggggatattgtatttcccctgagcgtacatgccaaacaccattccaggattctagatttggaggacaaatagaggaacttgcgtggcagaaattatcgacctccagagcacccaaaagcctctgacatgcaggagggtccttctttgagcttttccttgctccggtttcctcccctccccctcctaagaccagtgctcagagctcccaaggctgctgtttgatcatctgctctctgatccgagtctcctactgctcctacaggccttgaagttgaggccagtgctgcctggggcctcccctgatccactggctttgtagggagaggccggggtggaacagatccactgttgctcttcccttctgggcccaggtccagctcttgcaggctgggaatcactcttcttaccctccaagtcatctcttggcctccaggccatgcacgctgacccaccctgctgcttctccaccaccctctgcagcaagctcttgcccagagtccccacgggatctgccgcattcacagctcttcttgggtcactctgttacacaaaactgacaaggcccagagccttagcacagcatggctgacttctctaccatcctttcggtgttcctgctgaggctcggtgcccgctttgataaggtcctggctgggcagagggaggatgcacagtatggatttaatgaaggcgtctagtctgggacttcagcctccaagctctgtcacctaacaacaccctttcttgccttgcctgcactttaaccacttcctgtttggaattgaagtggtctggccacttgggagtctgtttcctcttgtcattgtcagaggagccccctctttcagacccttagtctttggctccccttacttgtaggtgaatatggacatggccggtgtggcttgggtttggggtggacacatgcagcagttgagctctgaagactcagacaaagacctagaaattgggactttgagacacacaagaagtgttagaaacactgtcacggaaaatgtcccagagcttgtcctgacccctgtcctgaccctaacctggagcatctggaagggaggaggcctcagtggcctctcttgacccccagggggctgaggagcagcagggggttgttttcctccttcctctcttctcccacaccagttctcaagggaaggcttccttccccattctttctctcttttttttgagatggagtttcgctcttgttgcccaggctggagtgcaatggtgcgatcttggctcactgcaacttccgcctcctgggttcaagagattctcctgcctcagcctcccaagtagctgggattacaggaatgcaccaccacgccaggctaactttttttttttttttgagacagagtcttgctctgtcacccaggctggagtacaatggcgcaatctccgctcaccgcaacctctgcctcctgggttcaagtgattctcctgcctcagcctcctgagtagctgggattacaggcatgagccaccacgcctggcttttttttttttttttttttttttttttgtatttttagtagagacaggatttcaccatgttggccaggctggtctcaaactgctgacctcatgatccgcctgcctcagcctcccaaagtgctgggattacaggcgtgagccaccacgcccagccctaattttgtatttttactagagacagggtttcaccatgttggcctggctggttttgaactcctgacttcaggtgatccacccacctcggcctcccaaagtgctgggattacaggcatgagccactgtgcctggccttttatttttatttttatttatttttttagacagagtctcactccatcacccaggctggggggcagtggcacgatcttggctcactgcaacctccgcctctcaggctcaagtgattctcatgcctcagcctcccaagtagctggcattacaggcgcccaccaccaaggctaattttttttctttttgtatttttagtagagacggggttccgccatgttggccaggctggtctcaaactcccaacctcaagagatccacccacctcagcctcccaaactactgggattacaggcgtgagccaccacgcctggccctttccccattctttcttcattttcctgaaactattttgtgaaatgctgccatcttgggcccctttcctcccttctctatcccacttcccaatccccccattagctttttaggtctgtacagcacccaggcatcagttggctctgaaagctatagcaatgtgactgcaagaagaattcttctctacatgtgtgtgcacacagagataatagatacagggattcatccccacagatacataaagacatacaagaagacacacgtagctagcagacttgtgtgttgattccctcaggcacacacactaacacacccactcatgagtgcaacccctcccagagaagacacaccacagaaataccagctcacatacagctcactccctgcttgcagatccacaaccacacacatgcccacggacacctgcacatgcagacacatacggggatgtgcatgccatgcacaggggagctgatggggcaacaagttggtgctgggaaggcagctggcaggaaaggtgcagacagagagtagagagggaataaaaggcaacctagaggcccagccagggctatctcttccagatttctccctccaaggtggggaggggtgcggatggggaggggagggctggagaagccggccagctgggggcggggctgagggcggggccaagagcccgggcttacccagatgttagtcactaacgtccttccgttctctcgtctctcttcccccacccttcccttcccttctcccctctcccagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaatgtgagtagctgaagggagcctgggcgcctaccttcgccgctatgttgggcccctctttatcttctacctcctcaccttctccctgttccggaccctgactcctctccctggcctttcctgggcacagggtgggcaggagatagccaggacgttgggtacccccggagagaagggcagggtagaaggtgcggggcgtgtcaggaccatggacagggacaggcgcggccgccggggcgatttcagcaccagggacagcgaacctggagcagggccccgaggtcttgggcctcctccatgctctccttagcccgccccatctctgcccgccccactccgactcctccgcttccatcccccaccacaggggtgtggcagcaggagaatggggtcgtccccagccctcagctggcttgtgcaaaggcctgtgttcaagtcttgtccccatttctctttcccctcctgggcccttggtcaccctgtctctgaactgagacaggaaaaggtggcttgaaaaaccctggtcccagcccagcagccttctggacccttttttgtgtgtagttatttggtgggggtgggggcagggctgctggagcatgtgtctatggttgtaacatttgttgggggcacaagcaggtgagtggatgttggggagtgtggccgtagggttgtgattaagcatggatacactgtgtatgtctgtgtgttcttgtgattgactgagcgtagatattcgtgaatgtgattttgacttccttacatgggtgactgtgtgagtcactctgttacttactggccaggcttgtggaggtcgggaggtatttgaccacgacatttgattgcattgggtcatgtgtatgtgtgagtggggctgaatgtaagtacacacttgcgtgtggggggtgttaccgtgatggtgttttctcctgtaagtagctgtcaggccgtgtgaggggcatgtcacagggtatcatgtgtgagggcatttgtgtctcttgagctaccaggctccagtcccttcccagcctcaccttgacacctttgtctctgggcctggacaaggaggaggccagtgtcactgagagacgagttggcggataggggttgggaagactgtctgtgccagcagtgggacaggggctgcgagagagaggctggggaggcacctggcgttgggaggcagtgagggcttggaggaggtaaaggggctggccccttagacacatacatggagggccagggccaggcagactcccttggtacagatgcacatggacacatgcacacaggtgcatgaagacaaggcaggtgcagggatgaaggagcagagccgctgagaggccacacaggtggaaacacacaccagtgaggcttttagacccagaggacacagaggtggatacacaatataacactgtacagtggaatgcaagccgtgcattctctacagaaagatgggagtggggagagagaactaggccaaaaggccatggcagctccaaggctgccctggtcactgaccagcacttgttcttgaccctgatacgacacagtgggcagtggcaggcagccggccctccctgttggaacctgtcttccatctctccctccccagccactccagccccctttgtctcttttcctgcttcctccacctagttggctttctgcatcctgtcatccctgtcaccatctccctccccagctcagggccctctgcagtgtccccagggagccccctcctccctccctggaccttcacactgaggtcttctgcagagacaaagctttcagaggcagcctgctgctccctccctccctcttctcccttcctcgaggccgccctggccagtgctctgcagagtcctggggctgggacagcagctctggcctctgccccagagagcttggtggctgtctgggaggaaggagggagaagaggagggctggcgccaaccccgcaggctatggaaactcagaggcagcagggcctttgggatagttttcagggggagggggcagcagggctctgaaggctgggccctggtaattgaaaacactcagctgtgctaattggattaggagggaagcaggctggagcaggggacggtgccttccaaggcatcctgaatgggtggggtcagttctgcaggccctgccaggccctgccagggggctgcaaggacactccttgttaaaggcaagaatttctctctccctgtctgctagagctggaggcatggcctggctgcctctgggctacatgccctgtgtgtctatccagtggagctcctctccctgggcatctctctgtcccatctccctgggcttgacctgccactgctccagcccagcgtgtgcccccttgttgccactgccagggcctcctctcctgccattccctctccacgggggggctgcaggagcttactatgtcccctgccatctgccccactctggggctgcctgtcagtatttctctccattccctcccttgctgcctgcctggatttctcagatgaaggacaccatggtaagttggggaggggtgagagtgtttcccagaaggccaaggagaagggtaaggaggccctcagctgagcctgcacccccgccctcctgagtgccggggccctgctcggctctccctgagcaccatgtgcttctctcacctgtgtggggctggctttgttctgtctctgccccagcctgggtactctgtcaccctcactgttcctctctgccattctctctggtcccttctcccctgtctggggtttgtccttcttggtttctgtgtcttggcttttgttgcccccgcttctttctgtcataccctttttgtctttctcaggcatctctttgtaacttacgtggctgtcccctctctccctcttttcatgtcccacaagcctcttttgttcttcccctccgttcgtccccctgtggccatggggcctccaggggctctggaccctgcttccctcacgatgggacaggtgctgaggctatgacaccagccaggcagcaccctcaccaccgctctctccaccctgtcttcagtgatggagccacctgtcatcacggaacagtctccacggcgcctggttgtcttccccacagatgacatcagcctcaagtgtgaggccagtggcaagcccgaagtgcagtgagtgatctctgccgtctcagcccctgttgcctgccactgaccccggccttgtgcctccctggactgcctaacttctaagcccagaagccccaaaccttgctaatcaccccaagtcctcgccatctcccagtccatcccctgggggccctggctgcttgcacctgtccctccagcctgttccagcccccgttgggttccagggcctcaggcctctgggcctttttccgcccacaggttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcgaggcgctgcagggaccagggagggcaggtcccggagttcgtgtgggattgtgggctggaagctgctgtcagccagttgtctcgtggcgaggggcctgggtgtcctgccagccctccaccccaccccagcttctcccctggcccatcttgtttcttgtgcagtctcctcctttgccctgtctctgtctccattgcacttccggtcatctcatgccctttcactccctcaggctttcctggtgcctgcctcatggctgagcaggaaggtggcggggggaggggggggcgggctggtggggggagtgactgattctgggcagacctgcctgagtcactgcagtcatctctgtctacacctgcactccttagcagggcccctcttctctggcttttccacttggctctccatctcctcccctccacctccgacttggtctctcttgctccacggctctgtcttgatctgtgtcgccttttccctggggttttccctttgcattccatcctccctgagctttctgcttcctgagcgctctcctctcccctccccacccctccagttaccttgggaaccgttgccatggtttctgtgtcaggatgatggaagggtctgtgactcctgcatccctccacagctcccctcccccatcactgcacctcagcctcagcctccccccacccgtcctttcctagggtgggcagggagagctgagaaccgtggaaggttaacccttcctggcctcctggtctcctgctcaccctggcctccctaagtgctagtctctgctatgagtccagaaggtatccagagtgtctgcctccttttctgtgaagtttctactggcctgaccctctcgccccctcgtccatccctggtgtagcccgccacccccctgcccccacctcccttctcctgcctagcaccatctggaccaggaggagagtgtcagcccgtctgtcccttctaggtgcccccaagtggccaaaggagacagtgaagcccgtggaggtggaggaaggggagtcagtggttctgccttgcaaccctcccccaagtgcagagcctctccggatctactggatgaacagcagtgggtgccggcgagcggctgcctcgtggggtcggggtgttagcgggggtgtcttcctggacggggtcatgacttcggcctccttgccccctgcagagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccagtgagtctcagaggctctgcactctctccctgactcctttcaccctcaggcatggcccttcccaccataggtccatctgacaactccaggcttcctcaagaacagcttggctcccacctctaccctgcccagaccccttcccaggcgtcgagagcagagacaggacactctccttaatggaggaagacacagaggccccgggggctggctggagtgtcgagtccctcagccttgcaattctggggtggagggaagagtgggcagcccacccacccactttctcctggcagccaacagcatgattgacaggaagccgcgcctgctcttccccaccaactccagcagccacctggtggccttgcaggggcagccattggtcctggagtgcatcgccgagggcttgtgagtctgggaacccagggcagggcagggcagggcagggtggcggagccctagcagggagctcagaccaccgcggggtatagggggctggggtgattggccttgtcctttctcccttctgctctcttccctttgcctcccgggcagtcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggagggtatggacctcctgggacagtggcctgtgatgcccactgtcatgggggaggggagggtctgcgccgggtcaagagccagctgctggctgcgggctcagggcggctctccccttcctcccagctgccccgtactggctgcacaagccccagagccatctatatgggccaggagagactgcccgcctggactgccaagtccagggcaggccccaaccagaggtcacctggagaatcaacgggatccctgtggagggtgagcagggcctcaggcaggagtggggagtgtggcgagccctgggggctgtgggggagaggaagaggagggtgaggaagggcctcaacgcagctcaatgccgggctgtggcccatgggcccacctgctgcatgcacagagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccgtgagtgccctcccttccttacctcctaactcccagtctgtccctgcagcccactgggccaggccaccagagtggctcagctggcagctgatgtgtcctcggcctaccaggctggcgccgacctttctccttgctgacacccttcgccccatctcactcagcctcacgatagccgagggagatgtaagaggggaaaggtcttgtcactgtgactgagcggaccgctgtgccacaggatgtgaccaaggccagcccaggtggcacctctcctggaacttcagggaaggctggggactaggccaggaaggcttctggggagaggtgactgtcagttaggcctggaataacgtaaaagttgggtggctgtgaccagaggcgcatctgaggcagagggcagtgtctgaaggcagagagagacacagcctggcgggggcctcagctgggagcagggaaccaagatttgcagggctcttgggggcccgaggaagccgtgcagagggtccctggctcctggcccagctgtggtcccaagtcctgccctgtctcctgaggctgttcctcccctagagctgccagccaagatcctgactgcggacaatcagacgtacatggctgtccagggcagcactgcctaccttctgtgcaaggccttcggagcgcctgtgcccagtgttcagtggtgagtgtctcgtcctggtagtggtgagtgtcgtgtcccagtggccagggagccagggagggcagggagcccaggccagccagtcagagccaggcccgccctgctccctccaggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaaggtcaggcaacccttgccacatggctggcagtgcctctgggagggagggtctgggcctctggaggacaacagagtgacttccccacgcacgcattaccctcagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtgaggacagtgacggtgaaagggggcagagtgggaaaagctggaagtccagacctcttggcctcgtccttgctttgatggggaaggctctgacaggagcgggggaaggagacaggagggagggatgggaggggagaagagcccagatggcaggaaagacagacacggctcctccgcaggtacttcatagaggatgggcgcctggtcatccacagcctggactacagcgaccagggcaactacagctgcgtggccagtaccgaactggatgtggtggagagtagggcacagctcttggtggtgggtaagtcctagggtggaagcctccactccagaaggccggggctcacatccctgggccctttcaagcaccgaccctccccaccctcagggagccctgggccggtgccacggctggtgctgtccgacctgcacctgctgacgcagagccaggtgcgcgtgtcctggagtcctgcagaagaccacaatgcccccattgagagtaagaggcttgagctcagtgccaccccaccgtcacttctgccagccctggcccctcctggggtcctccctcctcctggagccttcctggggggacacggtttggggggactcacggttcctcatgggaatctggagatgccagttggcctgggtaatcagggacccagactgtacccaacccctccacagcccttcccccaaagccacatgctgatcactccattgtcggttcatttcttggcagaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcaggtgagtcagggtggcacccactcccatgccacctggaaggggctccgggctgtgaagggagggcttagagaggtgccatgcccaagttcctctgcttccaaatttccagggggagcgcgagggggctggactcccttggtgccagaatgagccatttgttccttggccctcggtcctcgtggctctccaaaagaggctgcagcattgatgtgttaatactttcctttccagccccagagaagaaccctgtggatgtgaagggggaaggaaatgagaccaccaatatggtcatcacgtggaaggtgagagtccctgggctgagctgcctgggggacatgaggccatgacctgggtgtctgttgctcccccttggctatgcaaaggaaggggctgatgtctggggatgctggtttgtgctggggggcgggccaaagaatgctggtgttcttggccaaccaactcctcttctgctggcctcctccagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactgtgagtatccggcagggcccctcgcccacggttgagctcgcctgcttccaccccagcccatgtccacacctctcagcattggtgtgcgcctttcctaaggatgaggatattctcttacataaccagagcgacgttatgaaattccccacacttcacatttctataattggcagcggtattccagttatatcagccaatgctgcttctttcatttccttgaatctggaacatgaccagatggtaacttgaagtacccggtcaagttttttttctggtttctcctttttttcttttcttttttcttttcttttcttttctttctttttttttttttttgagatggagtcttgctctgtcatccaggctggagtgcagtggagcggtcttggctcactgcaacctctgcctcccgggttcaagcgattctcctgcctcagcctcctgattagctgggattacaggcacgcgccaccacacccaactaattttcgtatttagtagagatgcggttgcaccatgttgatcaggttggtctcgaactccagacctcaaatgttccactcgcctctgtctcccaaagtgttgggaatacgggtgtgaaccatcacgcccagccatggtttctcctttgtataagctactattttcacctttgcaactaataagcagtccaggaagagatcttgagaccatgcaaacacacctctcctcctcaaactgtacctcataaaatatccgaattcgtcttctctgtgtgtaggggcttgggcctggcctcagggctggggtgagagcctatggctctatccaagtcactggtggtttccagacccccaggcaatccctgagctggaaggcattgaaatcctcaactcaagtgccgtgctggtcaagtggcggccggtggacctggcccaggtcaagggccacctccgcggatacaatgtaagggttgaaggcatgggggcccaggagggtgatcactgaggtaaagcgacaggatggtgagggggctttgccacctgccagccgctctcctggaagacttgggttgagaggagggtccccattaagggtggtgggggtgtgcgctgggggccctgctgggtgccttctgcccctgcgaggtctcctgttcgcttgtgcaggtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggaggtgagtcctgcaccccacgcctcatcccctgccctcctccccagacctgggcgaggacctacctgccactcggttctgtgccctgcagtgcctggccaccccgaggcgttgcacctggagtgccagtcgaacaccagcctgctgctgcgctggcagcccccactcagccacaacggcgtgctcaccggctacgtgctctcctaccacccccgtgcgtgcgccgccccagcagggaagggaggtggaggggccacggggagggggcagagctgcagccacagccaacccctgtctgtccccacagtggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctggtaagctggaggaatgacctgccaacagggaggccccggccagccgggtccaggagggagggccttagacttcctggcagctgccacactctcctcgttcccctgcatccccccagggatctcagattttggcaacatctcagccacagcgggtgaaaactacagtgtcgtctcctgggtccccaaggagggccagtgcaacttcaggttccatatcttgttcaaagccttgggaggtaagcgtgaaagggggccttggggcgtggtggggaagggggctctgggccagaggggttgcctggcactccgactcacccctgctgccaccctctctccctggcagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggtgaggcgccgggggcccgccatcacctgccagggaagcatgggggctgcacaattcatgtccttctgtcccctgaatggccactactgcccaggctccctccacggctcctgtctgcttctcctcccagaatctgggtgtccccgaatcagccccctttcataccctttccgcagatgcccttttccctgtccctgtcactccttagccccccagagggccccaactttaagagcatacttcagggcctcaggtcgggttctggcttgggcggcagcacggggggctggtgtctcaccctcaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcaggtagcctctgagccccacgtgacgggggtggagccgagggcagagaggagcacctcgccccttccacccttctgcaaggcctcctggattccccgagctccccacaagatgacaggcgcatggtgggggcaggcagggggatcatcctcccaggccggggttggggcaacaggcaagtggtggctggaccgcagggggtgagcggtttctttcaaggcctcttgcctctgggcgctgttgagacagagtgctgggggtgcggggcgtagaggggcctggagccccgggtcaggctggggcgggagaagaagctgtccctctctgtgtctccagtgaaggataaggaggacacccaggtggactctgaggcccgaccgatgaaagatgagaccttcggcgagtacaggtgagccggggcaggagtgggtgctggcactcagctccaccctggccttcacatctcaccccctctctctcttctctgtgctgccgggtgacttcaggtccctggagaggtaaggcaggggcggtggggaggggccaacagcaaggtctccctatagacaatgtgcgcctggtgtgccattgtcccctggctgccggggctctgacaggactctcacttcccagcccccaggcccggcagctcctcatttcagggagaggccaacacgccccagcccctcctctccacacagataccttcactgctcccctctccccaagggaggccccagacagcttcccagacaggaaccaggccccataatcccctggccgagcgcacattttctccctcacagtccccaggatctggggaatgcccaaagatgacagctccagacctgcctgccagggtggccagagctgctctttctgagcgcattctaaacaaatggaaggcaggcgggcgtctgcctcacccccagccaggctcctgcaggggctcggcagtgctctcactcgcacctgccctgtgcctctgcagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggttggcaccttccccctcccccagccactccccagccagcctggctgggactgggaacagaactcggtgtccccaccatctgctgtcttttctttgccatctctgctccaaccgggatgggagccgggcaaactggccgcgggggcaggggaggccatctggagagcccagagtccccccactcccagcatcgcactctggcagcaccgcctcttcccgccgcccagcccaccccatggccggctttcaggagctccatacacacgctgccttcggtacccaccacacaacatccaagtggcctccgtcactacctggctgcggggcgggcacacctcctcccactgcccactggccggcctcttccagccgcccccaccccccaggaccccttagcagccctgccctccctatcgtctgaacagttgtcttcctcagcctcctcccgcccccaccttgggaatgtaaatacaccgtgactttgaaagtttgtacccctgtccttccctttacgccactagtgtgtaggcagatgtctgagtccctaggtggtttctaggattgatagcaattagctttgatgaacccatcccaggaaaaataaaaacagacaaaaaaaaaggaaagattggttctcccagcactgctcagcagccacagcctccctgtatgcctgtgcttggtctactgataagccctctacaaaaaaacaaaagtatatatatatatgtacataatatcagaattataacaggcaaataaaacctgaaaatcaagagcaccttttgttatttcgcggaacacttacttcccctgtccacgtcacactgtgggaggtgctaggagcgacctgccaggcgggcccgggtgtggcccagccacacagtcctgatgcttccctgccccttcccagagcccgggccttccacccaccctgccaggcctggctgttggctgccttgggtgttgctgtcacattgttgctggggctcaggatcctcgcctctgctggcctcctgagaccaagcttagctgtcaccatggccgggcccttcactgctcaaacatgagagtagagtgtggccagcggcaggagcctcttcccctgtctcaagggacacagctccatggctcagtggaagactcatgatgtgccccggtggcatcgttctctctggggtacccagccctctaaaccagtacaaagcaccttatttatttattttttgagacagggtctcactctgtctcccaggctgaagtgcagtggcgtgatcaggagcaggtgagaccatctacagccatagatggcaggacagggcttacctctgtagctggggattggttgcctggaagcacaaaggcattctctgtggtgatgcaaatgttctttagtttggtccgagtcgtggttgcatgtgtggataggcaggtaaaaaaatcaggttgcagcgacctgagattgtaccagtgcactccagcctgggcgacagagcgagacaaagaaagaaaaagaaagaaagaaagaaagagagagagagagagagagagagagagagagagggagggagggagggagggaaagagagaaagaaagaaagagagagagagacagagagagagagggagggagggagggaaagagaaagaaagaaagaagaaagaaagagaaagacaaagcaagaaagcaagcaagaaagaaagaaaggaagggagggagggagagaaagaaaaggaaagaaagagaaagaaagaaagaaaaaagaaagaaagaaagaaagaaagaaagaaagaaagaaagaaagaaagaaagaaagaaagaaaacccagcacaggtgagccctccacttcccgggctcaagaaatcctctggcttcagcctctcaagtagctaggaccactggagcacgccaccacgcctggctaatctttaaattattgttgtagagatggagtctccctatgttgctcaggctggtttcgaactcctgggctcaagcaattctcccacctcggcctcccgatagtgctggcattacaggcgtgagccaccacacccagcccaggactaagcaccttagatttatgaccacaagcctcaagtggacccaggcagagccagccttccttgggaattctagagtttcctccctggttctccaaggcctcacaccttcccctcagcccccaggccctgcactttcaaggtgagaactttgtttcatgtttcactgagcaagttgagagcatctgacgagaatttctttccttgagttcccatcatcaaatctgtcccctccccagccctagccccctcaggtgaacacttcccaccatgtgcagtggtctctgccacccctgagaccccctctctcctcctgttttctgcacctgtaatttttctctctccctgtggggtcaggcccagcagcataccaacatgcccttggagcttctatcaccggaagctcccgctcctgcctccgcatgccccctggctcttgccccgtttcactgctcctgtttacagcaaaacccctcaagactcctctacactcattgtcccccttgatccccacctgtaacagcgtccacttattgccctccaatatctgtttttctgttcttccataacactagatttgtggcttggggacatggcagctcagctgaagacccatttcccagcctctatgcacccagtagggtggtggggcatgagtgcacccatacctgcagggcaaacctgtgctggcgcctttcttccttccttccttcccttccttccttccttcccttccttccttccttccttccttccttccttccttcctttctttctttctttctttttttcttttttgagatggagtctcgctcgatcacccaggctagagtgcagtggcatgatcttggctcacggcaccctctgcctcccaggttcaagtgattctcctgcctcagcctccagagtagctgggaccacaggcgcccgccaccacacccagcttatttttgtatttttagtagagacagggttttgccacgttggccaggctggtctcgaactactgatctcaggtgatctgcccgccttggcatccgagactgctgggattacaggcgtgagccaccacgcatggccttgtgccagccactttctgtctccttacagctgaaaggcaaatgtgatctgtgatcatggggagagctaccttgtcgcaccaaagggaagtcgcacgttgaggatggcggaacagcaacaaaggcagcccgagggcctgagcacctggagctgccacatcggccctgggctgctttcctgggtttttaaaaaattaaggcattttgctttttagagcaattttaggtttgcagaaaaattgagcggaaagtaaggagttcccacagaccccgtcactccccttacgcctccccatgatgaacatttcgagtcagtgtagtacgtttgttacaattggtgagccacagtgagaagctcgcatgaactaaagcccatagctgacatcggggttcactctggtgttgtccatttatgggtttggacaaaggtataatgacatggatccacccttacagtatcatacagagtaactccactgccctaaaaatccgtgaaacaagtccttattgaggattactgtgcagaaaatcaagtgcacgcctggttttttcacctgcctatccacacatgcagccacaacttggaccaactaaagaacatttgcatcaccacagagaatgcttttgtgcctccaggcagccaatccctggctgcagatctaagccctgtcctgccgtctatggctgtagatggtctcgcctgctcctgacgggtatggaaatggaagcacacgctctggagccctttgtgccggcttctttctggaatcacttccatgagactcatccaggttgacgtctgtgtcccttcttccctctgtgatgctgactagtagccattgtatgcacgcatgcaccgcgactcacttacccattcccccgttgatggacgtgtgggttgtttccaatggtagccatcatggataaagtgggcatatgcagtcctttctctgagatccgtgccctagaaggagcagtgctggcttgtggagtgggcgtgccaccccctttgctgtcctctgcttggtgatgctcctgctttaccagcgcctccctcctaggctctgctagctgggggcgtttaagggagcccacaagactggaggaggaagaagggacctgctccttcctgggcgcaccatctaacaaggcttcttcacccttgcagcaagtgcttcatttccgtggcactgcctgaagccaattttcagatctctcaacacttgcaagaccagcttcattgcatcccacctctgagacaccaccaccggacacccagtgccctatgctccaaaatctgagtactaggccatcccctgagctcagagaccccagcatcagccagacccctgctccttagaggtctggatcccagccccacaagtccctctactgagctcactcctccacaactagctaggccacgcccccacctcagacctcagagacccagcttcagctctgtgggcctctctctaaccaacttccttccttccttccttccctccctttcttccccttcctttgttccttccttccttcctttcttcccttccttccttttcttctttctttctctttctttctttttctttctttctgttttctttcttctttcttttttcttctttctttctcttttcttcttcctttctctctctccttccttttctctttctctctttctttcttttcttccttccttctttctttcctttcctttttctttcttatcttttcttccttcctttctttctctctctccttccttcctttctctttctctctctcttcttttcttatttctttcccctccctccctccctccctccctcccttccttccttccttctttcctaccttcctttttctctctctctctctctctctttctttcgacagaatctcctctgttgcccagactggagtgcagtgggacagtcatggttcactgcaacctcaaactcccaggctcaagtgatcctcctgctctctcacagccttgatctcgggcttcttccctgcagaactgtgagagaatccatttctgctgtcgaagccacttggtttgtggcactttgctatggcagctccaggaaattaacacagcccctcaggctggggaacgaagggagttaggactcttcaaacagaggaggctgggtgctgtgactcacacctgcagtgcctgcactttgggaggctgagctgggaggatcacttgagcccaggagttcgagacattcgtctacaaaaaatacaaaacgtagcctggtgtggtggcacatgcctgtagtcccagctactcaggaggccaaggcaggaagatcacttgaaatctcaactgcatgcaccaagggaggagctgtcatcctttctacttcctgatcagatcctggctgatagcaaaattggcagctggagtggtgtcaagaatcatatcctgaaagatggggtttggagattggtttgtttgcgtccttgagcttgaaagcaatggtaagtttcagggtctcactcctcccgaccactgcctgacatttcatgtgagacacgtggcgaggctgggaatcaactgacgttgcgattctgtaacccaagcaattaaagtttgtgtttgatttagcactgttagccctgcaggtacaaggagtaagagaatttttagggctgacctggtagccctctggtgccttgcaagaggatacccattctcctctcagaacccaccacaaccaccccctgtcccataatgagggtgcaatccaccacaggtggacaggtacacactaaaacacaagaggaaaacctatacaccagaacaataacatgattttcgttaagaaatattggcaaaaacctgggcgaatatgtgtggaagtgaattctaaggatgttctaccaaaagggatggatataacattggattgggcacaatttcttgagctgggggcatttaccagagggcctatatttaatgttggtccatgcagctgaaagtgactctaacagcctatgtggttggttgatttaaactggaactcaactgtggcgtaaattcaatgatagtgagatgccagaacaacccttgcctaatggagagaaaggaacccaatgtcacgattctgagggaaatagcagagattagtgccttgaacttgaaggttgcagtcgtgatgtctcttgtatgctatttgtctatttggtgcttggcagaaggtggatggctcttcaagaatgaccgcaggtgaattgattgcagctgctgtttcagacgcagtcactttactgaagcaaagcgtcatagcccctgcgtctagcttgctactgccctgtcaaatagtaacaccagagaaaagaccaccagagcactttcttttattgctcaggtttgaaaagcttatgtatttgcacttcaaagaccacatttcttttaacctggcagggccaacagtacatcttcacagtcttccctaaaggctctgccatctctcctcctctctgacacgaaacggtacttacagactttgattctttctctctctctctcttaatttgagacaatctccctctgttgcccagactggagtgcagtggcgtgatcttggctcactgcaacctccgcttcctgggctcaagcggttctcctgcctcagcctcctgagtagctgggactacaagcatgcgccaccacactggataatttttttatctgtaatattttgtagagatagggtcttgctgtgttgctcaggttggtctcaaactcctgggctcaagctatcctcctgcctcagcctcccaaagtgctcagattacaggcgtgagccattgcacctggccaatagcagttgttttgatggtaaactttacaacttagcctctaggtcacagaatagttaagtggtactatgacttatttaaaggagaaattaatatcaccaataccgtgactgtaatttggagatgattacaaagactgttgggactttatgtctcccctcttgagaagagggtaggagcatatttgtatgaaggatcttgttaggcagaaacataaagttgtcattactgctgagggaagttcaaattatgcaagaaggcttcgaactgatgttgcgaagccaaaggggcaggggcggggaaggtgccatactctgctttgtgaggctggcgctgggactctgaacctacattccttctttgtcttctggctggttgtcagtttccaccaactgggacactagagggagactggaaggctgggaaggagagaagggtcttgctccttcctgtttgttttccattcctgttgctgtagcgccagtctcagttggcccttagcagcagcagtggtttcaggctccagctcatttcggccttctcggaacccgccagatgacaccccttcctcggaggtcagaggcccagttctacatgccccaccaagtgttggcagcaccagcagcagacatgccacacccaagatgtgcaagcccattgattatcagaggaacgcaaatcaaaacaacagtatcacttcatacccattagattgacaaatacacacacacctagaaatgcaggcaatagcaaatgctggcagggatgtgtggctagagagcgctcatgtactgctggtggagatacagaccaacacaaccattctggagaacaatatgtcagtatctcatcaattaagtatacactaggttgggtaattttggtaattctctgtaattctgctcttggggatacatcacaaaaattcttggctgggcgtggtggctcacgcctgtaatcgtggcactttgggaggctgaggtgggagaattacttgaacccaggagtttgagaccagcctcagcaacatggtgagacttcatctctgcaaaaaatacaaaaattcgccgtgtgtggtagcttatgcctgtggtcccagctgcgtgagaggcttaggcaggagcatccattgagtccaggaggttgaggctgcagtgagccatgttcatgatactgcactccaacctgggtgacagagcaatggcctgcatgacaaaggtcatggtagcattatttgtagtgactaaggaagcagataaaacattagggagtgttatgcagtacttggaagcaagattatatgtagactcaacaatataaatagagcctaaaacctagtgctgaatgacttctgtgtctggcaatgacaaaataagtaatttgaaccacaacctccactgagaacaactaaacagactcagtaaaacagggaaaatatttgcttgaaaatatccaagtgataataggcagtgaagcatatgggaccaagatatgggagaaaggaaatgagctgagagatgagctcagcatttaaggctgcttatcccctatggccatccgctaattccagcagagacagctgagggcccaagaagctgagcagaacagttagcagacttaagaggtgaggggtcaaaagtcagagtgcagggctcaccaaggaagaaggccctagtaagctcctcgtgctttgggttggaaacccaaaggtctaggaataagtgtaaactggaaatagaatagccctctaaaggactgcatccctgtcccctaagggactgtagtcaagatttgagctctttcaatccctgaaaattggattaaggtgatcaggatttctagtgccccagctgcctgccagaaacaaatgtaaattttctctggaggaagataacattgtccttggcctcaaatgatttatagtttccattcacaatgtccagcactcaataaaaaataacgaggacaaggcccagcatggtggctcatgcctgtaatcccagcacttgggaggctgaggcagggggattgcttgagcccagtagttcaatgttacagtgagctatgattgcactccagcctaggtgacagtgtgagaccctgtcttaaaaacaaacaaaacatgtcataaggagaaaagaaaatttaataaaaatgaaattagaaaagtaatataataaaaatagagccacaaggactccaaataatggcattatcagatacagactttaaaataattatatttaataattcaaggaaacaaaagacagaattgagaaatttagcagataatttgaaactacaaaaagaatctagtgaaaaatttagaaatataaaatatacaaattaaagttaggagctcaatgggtgggatatacaagagctgaagagagaaatagtaaacagaaagataaatcagaagaaaatagccagactaaagcttggagaggtaaaaaggtggtaaaagacaatgcaaaaggaggtaagaaacataggggatacagaaagaaggtctcatatatgtgtgtgtgcgtgtattttttttttttttaagacaaggtcttgctgtgttacccaggctggagggcagtggcacaatctccactcactgcagcctcgacctcctgagctcaagcaatcctcctgcctcagcctcctgagtagctagcactacaggcacatgcaatcatgcccagctaattttgttcattttttttttgtagagatgaggtcttactatgttgcccaggttggtcttgagctcctaggatcaagggatcctcctgcctcagcctcccaaagtgctgggattacaggcatgagcgaccatgcttgacctaatatatgcttaattggagttcagaaaaacaaggtgagaaagaatggggcacagataatatttgaagagttaatggatgaaatatttccaaactggtgaaatatatcaagtcagtttctagaagtcacgtgaaccaagagcgggataaaacaaacaaaaaaccacacctaggcacatcatagtaaaactgagggaaagcaaagacaaagagaaaacattcaaagcagctggtgggtgggttgattacttttatagttatgcagtttgactgacagccaacttctcaacacaaactacagaagccagaaaacaagacaatggtatatctgatgtgccaacaacaacaaaaaaactgccagccttgaattttatgtccgaggacaatctctgtccttggatcacaaaaatggcctcaaattcttgccatccctggatgcatacccttttgtgatggaactttcagctcctccctgcaagagatagagtccatttttccacactctcagatctgggcttggccatgtgatttgctttggtcaacgggacattaaaaaacacaaggcttaaaaagtgccaatatggctgggcgcagtggctcacgcctgtaatcccagcactttgggaggctgtaatcccagcactttgggaggctgaggtgggtggatcacctaaggtcaggagtttgagaccagcttgaccaacatggtgaaaccctatctctactaaaaatacaaaattagccgggcatagtggcacaggcctgtaatcccagctactcgggaggctgaggcaggagaactgcttgaagctgggaggtggcagttgcagtgagcagagatggtgccattgcactccaccctgggcaacaagagcaaaactctgtctcaaaacaagaaacaaaacaaacaacaacaacaacaacaactcaaataagggaaaaggtggtaggatggcaggactgactataatgtaagcttaggagcagctattcagtatttgggactctagagaaagtcaaagaagaaaagaagaaactgaaaaactctgtgttagctgctcaggtctgtttactgaaagggagtaactcctgttctgggcaacccagaaaggaaaggaagcaagacacgtgtcatcattgcaagaagcaaggacattggaagagggattgtccaaagagactggggcatgcaggatggcaggaacaagagaatcaggggtgggggcctaggaggataaaactctcagctaggagatactttgcaaatggctcaaaatggatagattgaggagatggcagtggcgggaagagattagggttaagtgtgtgtatgtcggtcactgtttgccaggctgacctgtccttgccttttctcatacagactggtgctacttattctgcatttgccttggaaagctcttgctcttgctttccatcagtacaggttgtttgtatcttgactcagccttctacatattcccttccctccaattcccatcagatgggccctctgcctttgcctaaggagcaagtgctcccctttcctcctgactcttctgtaaacctattggcgagagacctgccatgcacctccaagcctaccatattcagtgccggaaaagcccccttcctgagctgacacaaatcaaggcatcttttgagccctagagaatcgagatgctgatttaatttgagctatagaacccataaaatcaatttaccaaagggataagccatagctgtgtgtaaaacaatctcctttgttgggagctcaattagaaggaatgaaataggttataaaagaattagaggccagatgtgggggctcacctgtaatcccagcactttgggaggtcgaggcaggaggatctcttgagcccaggagtttgagaccagcctgggcaacatagcaagaccctgtctctacaaaaagcaaaaaaaaaaaaaaaaaaaaagaaagaaagaaagaaagaaagaaagaaagaaagaaagaaagaaagaaaaattagcgaggcgaggtggtgcatgcctctagccctagctactcaggaggcagaggtgggaggatctcttgagcccgggaggttgaggctgctgtgagttgagatggtgccactgcactccagcctgggcgacagagcaagatcttgtctcaaaaaaaaaaaaaaaaaatagagaaacaagggataatttgaaaaagccaccactttgaaatagtctcacacttctgaaagagaagagaggtaaaagtgatgaagatggtcaactgctaaatttatttgtataagatcttaaagaaggccgggcatggtgtctcacacctgcaatcccagcactttgggaggccaaggcaggcagatcacctgaggtcagaagttcgagaccagcctggccaacatggtgaaaccctgtctctaagaaacatacaaaaaattagctgggtgtggtggcacgtgcctgtaatcccagctacttgagatgctgaggcaggagaatcacttgaacccggggggcagaggttgcagtgagccgagatcacaccactgacctcagcctgggcggcagagagagactccgtctcaaaaaaaaaaaaaaaaaaaaacttaaagaagtaaatatgtgtgctgttctgtttactccagcaactcttctgactttggtaccattgtctgcaaagtttttctctgtaattgatcaattttctgcattttctgtctttccattcctctagcagatgaatctaaattcttgtttgcttttgcttatgagaaagtctgatatttatggcaaagaattcctcaagggttttgaatgctcccattattttctctagtcatttacagaaacacttagaggaatttctcccaccagagggatctatgattatttgctatgtagacgacttgctactagtagcctcagaaactgaagagcaatgcaaaactgatgctttggctttactgcaatttctcatctggcggggacataaggtcttgctagacaaattgcaatagtgctaacctgaggtgaaacaattagggcatctgttgtcagctgtgaagaaagagaaaaagaagctgatccttaggcaggaagtataaacaacgggaaagactctcttaataaatatgaatctcccttttggaataccagagcatttgaatcagacagaaaaagtcattttattcctactgtcatccagtagcataaaaaaattaatgaattaattaacagattaatgaatccagctctgaaagactcattggctaagattctgcaacctacaatgttaagatggcctggaactttcccactagccttgtttaaaattacagccactcctttaagcaagcatggcctagctctaacttgggtccaagaccaagtcctgtggctgattttttttaatgtttttatttatttttattttttgagaaagaatcttgctctgttgcccaggctggagtgcggtggcatgatcttaactcactgcaacttctgcctcccagattcaagtgattcttctgcctcagcctcccaagtagctgcgattacaggcatgtgccaccacacctggctagttttatttttttgtattttttgtagagatgggattttgccatgttggctaggctggtcttgaactcctggcctcaggtgatccacctgcctcagcctcccaaagtgctgggattacaggcatgagccactgtgcctgtccttcctgtgcctgatttaactgaatcctcccgtaatcatactcaatacttaatagggcttttctcttctttagaaaccatgagacttaaaaagtcagaaggatctggaggtaaccctccaaagaagtccaccatcccagttgactgggaggtttcctctgcatcaaagcttttccaggggaaaggcctgggctgccactgtgctgagaggaatgttttcaaatgctactgatcacctacagggccatcggagagaaagaaaaacgcagctggactcttgggaggattgcattgtggttgccacaaaggacttttcctgtaactgatattggctgctctatccacagtagtagttatttgaattactgtaagactcacatttttactaacaaacatgttatttgttaactttgaaattgatctgtttggaataatttaatgctgggaagacataatctcatcaagctgtaggaggccctcactcatagcccagcagcgattagctacaaaacagttctacaatatcatcattagcaggtctattcatatttaaggaaacaattagatattgggagtatgactatagaacagatgaaaagaacagcatctaatcaatagacaaatagaaagctggcatatatagacagaggctgcgaagacaggtatagtgtcacttcattaattgtacaatgtaagttctctccagtcccagtatggatagataaacaaagggttgtctgttatccagggagacttaataggctgttataataacataacttgattgggactgatgcctgagaaagtgccgataggatgagttttcctcaacttaaaacagatagggcagtttgggctcggtggttcatgcctgtaatcccagcactttgggaggccgaggtgggcatatcacctgaggtcgagagttcgaaaccagcctgaccaacgtggagaaaccccgtctctactaaaaatacaaaaattagccgggcgtggtggtgcaagcctataatcccagctactcgggaggctgaggcaggagaatcacttgaacccgggaggcggaggttgctgtgagccgagatcacaccattgcactccagcctgggcaacaagagcaaagctccatctcaaaacaaacaaacaaacaaaaaacagatagggctgtgtacattacaccctggaagttcatagtaagactttgatctgccgggcgcagtggctcacgcctgtaatcccagcacgttgggaggccaaggctgacggatcatgaggtcaggagatcgagaccatcctggccaacatggtgaaaccccgtctctactaaaaatacaaaaaattagccaggcgtggtggcaggcgcctgtagtcccagctactcgggaggctgaggcaggagaatggcgtgaacccgggaggcggagcttgcagtgagccgagaccacaccactgcactccagcttgggtgacagagcgagactccgtctcaaaaaaaaaaaaaaaaaagacttcgatcctagatatggccataggtatctttgtagttcacattgagaaataccactcaggaagacaaaacaattaccaaagtgcctacattattattgtcaatatgatgttacagggccaggcatggtggctcacgctcgtaatcccagcacttcaggaggccaaagtgggtggatcacttgaggccaggagtttgaaaccagcctggcctggtggtaggcacctgtcattccagctactcaggaggctgaggtaggacaatcgtttgaacccaggaggtagaggttgcagtgagctgagatcgtgccactgtactccagcctgggcaacagagcaagactcctcaaaaaaaaaaaaagttacatatatatacatatatatgtgtatacatatatatatgtatatatatgtgtatatatgtatatatctatatatatgtgtatatatgtatatatctatatatgtatatatctatatatgtgtgtatatatatgtatatatctatctatatatatacacatacacacatatatgatgaaaactcaagaaattctgggggtcttacaaggaaaactcttcattaaaaatttataagactccagagttaaactactccttaagcttggattggataagattttgtaaggagccatgaaataatattcaaatggttagccatttgaaagctcaggcaatgaagatgtcatgacagctagtacaattaatgtgtgatggagggaaatgtttacacatttgcctacaaagaatctgattgaaccctgaaccattgatgtgatatatttgaaggttgtcctccaaggcaagtattgtactgaattcaaaaactgatgctattgcaattgtggtcattgttttgcattttactacgggctagctggatatttaggcatctgcaacttgcccagaagaaggtaaaagcaacaatggtgttaattaaatatcgcaatgttattatttcatagtaacacaggaagaagattgtaagggcaaatacagattaaaaacaagaggcttaattctctctgttgaaaataaggtaagagactccctgcacctttttcctttatcttttggaatttctttctctgtccttttcaaatgtatgtagatgtttttaatggctaaagaagctctggccagtttcacaactcaggaatgtttcctctcctctgggatccgggagccagcttttcgaaatgtaattaatcatccaggaagataactctcttcatctctcagtttcagctgccacctggctccgaattgtgaaacctgcctactgtagtggatacagacccacttagctgtatagaagagtgaggccctttctgtcttttgtttttaattaaatttccccaacatactccatagcaatggggaaaggacaacacctgttataataacataacttgattgggactgatgcctgagaaagtgcctggtcagatgagttacatttccccaacatactccatagcaatggggaaaggggacaactcctttccccattgctatggagtatgttggggaaatttaattaaaaacaaaatcttctcccaacccagaaaacctctccacaaaagtagaagagaaagaaaacaatttataattgaatacgcattaaaccagaatgcggtgtgcatcacaggtaacccactggaggcattgcaaagacagaaaggaagaagactagcgccctagcagcccctttgggtcatggcctcgtcccaaggatgcagagggcgggcactgagaccatgaaggcatgaaaggagaggaaggacttgatttgcgagttgtgcaagtcatagaattggcaatatcccctccccaggggttcacactgtgcattttctccagcaggcaattgtgatgggaccagagaattgccaatggctcccttgcaatgtaaaagtgcccaagttccgatatgtgtaagcaaatgcctctgccctcaaagggagatgcatctcaatgcactgttgcttttaaaggaagagagtactttggtcagcttcctggcattgcttaaaaacaagacccaaaatggaccttgtaataagaccctacagaatccttcttgaggatcttcagcctggaagtctttttgttttttttttttaaagaaaaaacaaattttgaccactgcctgacattatacacaaaaaaatcaattccaggtatgttgtagatctaagaacaaaaggcaaaacaataaagcttgtagaagacaacaggagaatatcttcaggacctggggcttgggaaagatttctgctttgcttgctaggaggctgtctgactcctcctttggccaacaatggagttggcagggggtttccatgcaccccgttgcttttgtgttgctatgcagaagagtggaaatgctgtctctcactaccacctttacgtgtttctacccagtatccttttagaagagatgttctttctttttcaaggaacgcctgtcgaaatgcatcaaatgcctagtcagcaactagtgatcctgtgagtttcctcctttaatttgctgagtaatgaattctgtggaaagatttcctgatgttcaatcacctctgtatttctggagtagacccgaaattctattctattcataataatagaatattatgtcttgctcagacataatgtcttattcttttgctatatcgctggaatccatgtgcttatcttttatttataatttttgcatttgtaatcagaagtgacagttgttcacaggtttctttttgtactctgtttaggaggtttgggcatcaacctaggtttaggtattgttggctttatgaaatgtttttgtgtggactggaatagtttaaatgatatcagaattattttgtcttgaaagattatataggacttggctttgaaactacttagggttggtactgtttttatggagaatcccctctctattttattttatttgacacagggtctccctccattgccagggctggagtacagtggcatgactgtagctcagtgcagcctcaaattcctgggctcaagcgatcctctcacctcaccctcctgagcagctaggactacaggtgtgtgccaccacgtccagctaattttttaatttttgtttttgtagagatgggagtctcactatattgctcaggctggcctcaaactcctagactcaagtgatcctcccaccttggcctcccaaactgttgggattacaggcgtgagctactgagtttggcttccttctctactttaaaatggtaatttgtagactcaaattttctagttcttgttgggttttcagaaagttatattttgttaggaaattatcaatttttttctgttgttaaagaatcagcttttgtatttatttacaatttttactattttatgtttttaatctttattctctttttcccccttcctttgtttcccctttggcttctctcattctttttctggttgtcgttgacttttgatctatcctccttaatcatgcatatcttgactattctaactgcccctcgtggaaagcttgagttgtgtgtagaggttggggtaagacgtgttcttcttttcacgatgctctcgaagcttgtcgcttctgtatgctctcctctttaatccaatgattgcttaagataagttttttcttttcaacttcttactttgaaaatgtaaaaacctacagaaaagttgcaagaacagtacaatgatttggtctcatcatttgatatactattcaggcataaaaagaaataaaatactgatccatgccacaacacagatgagccttggaagcattgtgctgagtgaaagaagctacacacaaaaggccacatagcgtatgattccattcatataaaagatcagaataggcaaatccatagagacagcaaggagatgaatggttgccaggggctagaggaggggggaacggagattgattgctaacaagtaaggggtttctttttggggtgatgaaaatgttctggaattattagtgatggtggcacaacattgtgagtatactaacaaccaccgaattgtatgtatgctttaaagtgggtaatgtgattacctttttttttttttttttttttttttttgagacagagtctctgtcaccaaggctggagtgcagtggtgtaatctcggctcactgcagcctccgcctcccggttcaagggattctcctgcctcagcctcctgagtagctgggaccacagatgcgcaccaccacgcccagctaatttttgtatttttagtagagacggggtttcactatgttggccaggctggtctcgaactcctgacctcaggtgatccgcccgcctcggcctcccaaagtgctgggattacaggcgtgagccaccatgcccggcctattgttttttttaattttgcctttaaaattgtgaattatatgaaaatacagaaaatgtatacagacagtttaaggactaaaaataaaccaccaactactgatgacaataaacctgaaacaaagtagaaatatactaaatttactaaaacagacaaaaaaaggccgggcatggtggctcacacctgtaatcccagcactttgggaggccgaggcgggtggatcacttgaggtcaggagtttgagaccagcctggccaacatggtgaaaccccgtctctactaaaaatacaaaaattagccgggcgtggtggtgggtgcctgtaatcccacctactcgggaggctgagacaggagaatcacttgaacctgggaggtggaggttgcagtgagccgagatcatgccacgccactgcactctagcctaggtgacagagtgagactccgtctcaaaaaaaaaaaaaaaaaaaaagcaagcaagcgagccctagtaaccctaaaagtataaaacagattgaagcagcggtttaaaaatcttcccacaaataaaacagccggcccgcatggttttacagacaagttctagcaactctacagactctgccagagaattgaaaaggaaggaccattacccaacaaaaccttaatattaactaggcaaaaacagaacaagataggaagattgtaggtccattttggtctggaatacagagacaaaagtcctaaacaaaaatttttcttttttttttttaatgcagggaattctaattagattggcatagttaaggccaaaactatagacattgctcccttatttaccttcaaccgttgcctttaagaggcaaatgaacacaaaacacaggtgaatcttgcttggttctaagacagtgaaggaatttccccagtatttacatatattcacataaccagtcatataaatctaaatataaaaccaatctccagtaagttttaagacggcactcaccatctttgtgaaaagttgaacattactaacgaagtctaatcatatctttagaaggggtaaacagtgatagcatttactgaattggagttactattaaaattcaagaactgaacgtattcatttaaccacaaaccagtcttagttttaaatcaggactgctcaacaaaatattctgtcagtcattcatgatctgaattctggtgtatgagatctattaaaggatggtatgcatacaaaagtcatgagacatttctgttttgtaataaacaaggcagtggccaattattactcattagtagcttttttgagaaaagctatcgagtctgccctttcttccttcttcttaatgccgacaaagatcatttttgtttcaggtatgtgcttcttgggattctccaaatactccatcagtgtatcctctccccaggtgatgcctttgttcttactggcaaccgtgtaagagtatccagcggcctgacctgtcttccgcccgaagaggccttggagatttggcccagtcttgtgcttgcctcccttttcaacggtgtggcactgggaacacttcataataaaaatcttcttgcctttctcaacatcacccatatttaattctccttttagtcgctggcgcagcgaagattcccgctccgaagctggacgtccccactctcacaaaaatttttctaaaccaaatccaaatgtgtataaaggaaaatagccaataatgaccaagttcagcgaatgtcagtaaagcaaggtgatttaatattagaatgtccataaatgtctttttttttttttaacagagtcttgctctgtcacccaggctggagtgcagtggcgcgatctcagctcactgcaagctctgcctcctgcctcagcctcccgagtagctgggaccacaggcacccgccatcacgcctggctaatttttgtatttttagtagagatggggtttcaccgtgttagccaggatagtctcgatctcctgacctcgtgatccgcccgccttggcctcccaaagtgctgggatgacaggcgtgagccaccgcgcccggctcataagtgtcttttaacccaggagcaggataaaggagaaagacgctggtcatctcgtcaagtgcagaaaaagcatttgctaaaattcaacacttattcataacaaaaactcttaataagctgggaataaaagggaacttcctagacttgataaaatacacacataattgtattaatagagaaatgttagaaatattttctttcttttttttatatatattttttattttgagatgcagtctctgtcgcccaggctggagtgcagtggcgcgatctcggctcactgcaacctctgcctcccaggttcaagcaattctcctgcctcagcctcccaagtagctgggattacagccacctgccaccatgcccggctaatttttgtatttttagtagagacggggttttaccacgttggctaggctggtctcaaactcctgacctcaggtgatccgcccacctcggcctcccaaagtgctgggattacaggtgagagccaccgcgcctggcctagaagcattttcttaacaatcagtaacaaagcatgcctgtccacttgtgccacctcttctgggctttgttccggaggctctagccggggtagtatagcaagaaaagaaatgcaaggcataaagattagaacggtggaaatacatctgtcaatatttcacatgaagtgatcttctgaaaaaaacaaaaaaaaaaattccgaagagggtataaagacaaattattagaaagaaaagagactttagcaaactgactggacataatgatgaatatacacaagccaagtgtatgtctatgcaccacccatagtatttagaaaatgcgctctgtaaaaagacgtcatttataatagcaacaaaaaatttaaaaaactcagaagtaagtaaaataaaagatgtgggcggggcatggtggctcatggctgtaatcccagtattttgggaggctgatgcaggaggatcacttgagcccaggagtttgaggctgcagtgagctaggatcatgccactgcactccagcctggacaacagagggagaccctatctctaaaataataataatcataaaaagaaaaaagaaagatgtacagaaaattctaaacacactttaaaagacctaaataaatggagagatattcaatggtgattgttaagatagtgtcaaatctccccaaattgagtgaacagattcaatgccactctaatcaaaatccccacaggatgttttgagaaactaaagttcattctaaaatgtatatggtagagcaaaggtcaagactagctcagaccaccctgaagatgcacgaggagggcttgcctggcaaataacaaggcttattataaaactatcataattaacaaagcctgaccttagttcgagggtagacaaagtagccagtgggacaaaatagagagccctaaagagaccccagaaagatggacctttaatatatgacaacagcctgggcaacatgtctctgcaaaaaataaataaataaataagtaagccagatgtggcatgcatctgtggtcccagctactcgggaggctgaggtgggataatcacttgagcctgggagattgaggttgcagtgagctgtgatcgtgccactgtactctaacctggatgacagagtgagaacctgtctcaaaaaaaaaaaaagagagaaaaatacgtatataatatgacaaggtggcaaggcagattagcgaggaaagagggattatttaacaaaaggagaaggaaatagaggtgatttataatggggaaaaatgaaattaggccctccacatcttacacaaaaataatttccagatggattaaggatttaaatgtcaaaaaggaaactttaagattcttaaaagaaaatgtaaaaagtatctttctgaccttggattagaaaaggatttcttaaaccagatataaaaagcattaatccttaagaaaaaaataaggtagccgggcacagtggctcatgcctgttatcccagcactttgggaagtggaggtgggaagatcgcttgagcccaggagtttgagaccagtctggacaacatgatgtgacctcatctgtacaaaaaattaaaaaattatctgggtgtggtgggtgcctgtagtctcagctacatgggcagctgaggtgggatgatcgctttagcccaggagttcgagccatgtttgtgccactgcactccagcctgggcaatgaaaccctgtcaaaaaaaaaaaaaaaagaaaagaaaagaagagataagatggatttaattacactagaattagaaacttctttttatgaaagactccttaaagaaagtaaaaaggcaagcttcaaatgaaagaatacacatagctggcaaaggattagtgtctagaatatgtaaaaaattcctacaaatcaataagcaaaaggaagaagaaaatataaaaacgggcaaaagacaactccaggcaaaacagaagagaaaacacatgtggcccagaaaccatggaagaaaagagcagccttgctggtaatcagggaaatgcaagattatggtggggtactgtttcgcacacatcagtctggcaaaaacgaaggaatcccccaaatagcaagagttgaaggagatgtacgcttgaacccgggaggcggagcttgcagcgagccgagatcacgccactgcactccagcctgggctacagagcaagactgtctaaaaaaaaatagatgagaaagatgtagatcaaaaaggatcttgtacacattgttagtggaagtgtaaattgataggagcactttggaaaacaattagggcttatgtaaagttgcatgctggctgatcttacagtaactcccaggcatacatacaagagcaacttctcccccttgcactaggagacaggtacacaaatgtttacagcaatgctgtttatttatttttattttttgagatggagtttcgctcttgttgcccaggctggcgtgcaatggcacaatctcagctcactgcaacctctgcctcctcggttcaagcgattctcctgtctcagtctcccgagtagctgggattacaggcgcatgccactacacccgtctaattttgtatttttagtagagatgggatttcaccatgttggccaggctggtctcaaactcctgacctcagatgatctgcccgcctcagcctcccaaactcaactaaagaacatataattttaagcatatatgatacagctatattaaaaaaaaaaaaaaaaactaggccgggggtggtggctcacactggtaagcccagcactttgagaggctgagggggagggatcgtttgagcccaggagtttgagaccagtctgggcaatatagtgagaccctgtctctacaaaaaaaattgtaaattattagctgagtgtggtggcatgtgcctgtagtcccagccacttgggaggctgaggtgggaggatcagagggaggatcacttgagcccagaaggcggaaggtgcagtgagctgagatggcaccactatactccattctgagcaacagagccagactctactccctgctgaaaaaaaacctaagtgggaagcaacccaagcacccatcgacaaatgaatggataaagaaaatgtggtgcacccgcacaacagattactattgcgccataaaaaggaacgtagttctgatgtatgttacaagatacatcaacctgaaaacaacatgctaagtcacataagccagtcacaaaaggacaaatatggtgattccacttacataaaatatctagaatgggcaaattcacagagacagaaagtggctacaggttaccaggggctgggggagcaggaactggggagctattgctcaacgggtgcagagtttctgtttggggcgatggcagtgtttgggaaacagtggtgatggccgaacattgtgaatgctctacttatacaacacaagtcagttgtaccactgagtcatactgaaaaatggttacaatggcaagtgttgtgttatatatgtgttctatcacaattttattttattattttttatttttttgatatattttttccagacagggtctcgctttgtcacccgggctggagtacagtggtgtgatcatagctcactgcagccttgaccttctgggcttaagtggtcctcccatctcagcctcctgagtagctgggaccacagtaacgcaccaccatgcctggctgattttctaatttcttgtaaagacgtggtgtcactatgttgccctggctgctatcaaaattttcaaaagcaggagaataataaatgcaaaatgcaggatactggttatcttggagtggggaggtggtgttggggagacagcagagcacctgggtgtatttcagtagggcattggtacggggcccattcctgggctggccagtggacttacagacattcattagcttattttgtatttattttattttatttattttctgagatggattcttgctctgtcccccaggctgcagtgcagtggcgcgatctcagctcactgcaacttctgcctcccgggttcaagcaattctcctgcctcagcctcctgagtagctgggattacaggcgcctgccactgcgcccggctaatttttttgaatttttaatggagacggggtttcaccatgttggccaggctggtcttgaactcctgaccttgtgatctgcccgcctcggcctcccaaagtgctgggattacagacttgagccacctcgcccagccttattgatttacttttttgagatggagtctctgccacacaggctggagtgcagtggcacaatctcggctcactgcaacctccacctcccaggttcaagtgattgtcctgcctcagccttctgagtagctgggatcacaggcatgcaccaccacatctggctattttttttttgtatttttgttagagactggctttcaccatgttgaccaggctggtctcgaacttctgaccttaggtgatccgcccacctcggcctcccaaagtgttggccaccgcgcacggccttagcttattttctaaacagaaaataaaacgaaagagggccttgggtggacaagtgttgatggataatgataatctggctctgtcaacttgaagcaacaacaacgaaagacagaaggaaaataccacgttcatatgagaacatgagaagccctccggggccctgcccatctgaaaaaatggcgtagtaggccacgtgcaggtggctcacacctgtaatcccagcactttgagaggttgaggtaggtggatcacctgaggtcaggagttcaagaccagtctggccaacatggtgaaacgccgtctctactaaaaatacaaaaattagctgggtgtggtggcaggtgcctgtaatcccagcagctagggaggctgaggcaggagaatctcttgaacccgggaggcggaggttgcaatgagccaagattgtgccactgcactccagcctgggtgacacagcgagactctgtctcaaaagaaagaaagaaagaaaaaaaaagtgtagcagaaatagaccaaagagcaaaggcaattcaatggagaaacggtagccttcccagcaaatggtgctggaacaactggacatccacatggaaaaatgaacctaggcacagactgctgtggcttgaaggtatgtggccttccaaaattcatatgctgaaacctaattatcaagatgatggtatcgcagggtggggcctttgagaggtgattcggtcatgagggctctactctcatgaacaggattagtgccctgataaaagaggcttcatgcagtggtcttgctttactccccttttccaacacgtaaggacatcatgagaagatatcattgatggaacagaccttcaccaggcatggaaccagttggcactgtgatcttgggcttcccagcctccagaactgtgagaaaaatgatctgagacagaccttccatccttcacaaacattatctcaaaacagatcatggactcaaatgtaaaacacaaaactatcgaatcctagaggataacatgggaacatcaggtgacactgggtttggtgatgacttctttagatacaaggccaacagcacgacccatggagagagagaaaacaaagcagcaaactcagctcatggccaagtaaggaaagggcaacccggttactccaggccaaggctcccaggagaagggagctggacagagtttctgggtcgtggtctggcttcagcctccctgacagtcccttctggaaaagccagtgggcaaggtcgttagagactcctgggaaacatgggtccccactcacacatctgacacggctgggctggggactggggattgcacgcatccagtggaaaaaatacagttggccttcatatccgtgggtttcacatctgaggattcaactggccatggatggaaaacacttgaaaaataaaaaatagcaatacaacaataaagataatacaaattaaaaaacaaatcaggccgggcacaggggctcatgcctgtaatcccagcactttgggaggccgagttgggcggatcacgaggtcaggagatcgagaccatcctggctaacacggtgaaaccctgtctctactaaaaatacaaaaaattagccgggcatggtgacaggcacctgtagtcccagctactagggaggctgaggtgggagaatggtgtgaacccgggaggcggagcttgcagtgagccgagatcgcgccactgcactccagcctgggcgacagagtgagactccatctcaaaaaaaaaaaaaaaaaaaaaaaaaaatcattacactataactgtttatgtaacactgacattgcatccggtaatacaagtaatctagagaagatttaaagcattagagaggatgagcaaaggtcctatgcaaatagtatgtcattttagatcagggatttgggtgtccatggattttggtatccccagtagggggaagcctggaacccatgccccgtggacaccgaaggacaactgtagtcagaagggtgggatcttctgtgtgtcctgcttctaagagcaccatggcctttttgcagctctctatggtgggtcagagtggagcccttctgtggggtgtcatggcatcctcagtgggtccaagctctgggacgtggagggagagcagggacctacctcatcagcacagagtaagataggacccatccagataggaatctgggccagactcacctgggtacccatcttcaggttaaagaatgctggagtgccccggggagcatggtggtgccgccctcaccctgtctctatcttgagcgcaatcgcccgctccagcctgactgctgtgctgggatgtcactgcactgtcctcaagctgcactgtcaagcgcagtaactgccccatgatcagctgtctctcatgtccttcctcccggacgctctcccagggctgtatatttgttagggttttctgattacagggagaagctgactctaactttagcaagaaaatggatttatctggcatgatgctgggtagatcaccaaactggtggaatgtctaatggagcggggtttcggacacacaggcgagaccggttctttttttgttttgttgttttagagactgagtctcactctgtggccccggctggagtgcagtggtgcaaccacagctccttgtaacattgaattcctggggccagccatcctcccgcctcagcctcctgagtagctgggactacaggtgcgtgccaccacgcccggctaactgagacctgttttgagtgggatccagagcaagaaaggaccctgcaggaggactgggctgcggggcaagctgctctgccaccagcagcgagagcccgccaacctaacggtgctggagggatctgtccatggtaggccaggatgctgtgcggaaccctcaggaagcctcaatggaaggatcccagcagggaccatagaggctgtggcagggccacaccttcggtggcagagctactcactcaccactgaaaaaagcatagctgtggccatgctactgggacctaggagagacttacagcctgatcatggggcatccagggcctgtgtgacccaagccacccattgtgaactgaatattgaggtggagatggcacattgaggcccaggcagtccagacccccggtcacccggctctttcacactggtatgccccttcagctcacacctatggcctcatgggaggtggtgatggggtgtccccatgactgactcagacccaggtcctcgactggtcatctcatgtcaccactaggaaaaacacctgctgtcacactgaggccctttgcagggtggccctgagagacagcagtgaggggacatcctctaggggagcaagacactaggttgtctactttgtagagggagaaatggcctgagatgaaggtgtccatgacccccgggcagtggaaaatggctgggctgactggtcagggacccgggtggaggaagattggaagaagagacaggtttggcgaagaggtacctacgggagtgctcagggagagtgtggggccccgtgctcgtcttcgcgcccatgccgctggggagcatgcagtgtggagggggcgcgccagaagctagcgaacagaggggaccatctggtggaggtcagccagcttctccccaggatgcgatggacccacgatgccagtggccatggtgggagggctggaggctctgtataagcccaacggcaagggcttcctcttaccacggctcatctagacactgccgctagtgaatgttcttccatccaccagctgcagagaccgatgctgagccctcaatatgacgccattcctcaagactagccagccattgggtggcaggttgcaacctgcacaccagcccttgtctcaagttctgctttctgggagaagccctggataagaaactcgcctctcttctccacattctgggcaggcccgccattcttgatttctcttctaacgaggagccagggaggaaaggaagggctccgattcaacagccccgtgtggctgggggttccctcacttgcccaaacctggaaatgaagcatgtagcaatttctccaagtgatctcctgcagccggggcagcctctgggaacgcagacttccacccgctgctgctttccaggcaaaggccttctccctccaggcttgtccaagaagacggggaggtggtgggagagaagaggaagagatggaagggctgtgaaagcggggaccgggtgagggctggggctgaggaacaggtaggcggcgggcccaggctggccagtgctgtgtgcaggcccgggtcccaaggcctccgaggccactctccccacgacccaccccctccccacgcttcgctcatccttttttctttctctctttcttttctttcctccctttctctctttctttcttgttttaaacaaaggtgtccgtttcaaagacagcagggaatggctgagttgaaggagggatgcagtcatttaaggcgaagcccgaggaaggagcagaggcgtgagggctgctgcgtccaagaccggggagaggggctgaaatcgcggactctctctgggggacccaggagactgctcctcctggcaggacccctctctcccagagcggcatcgcgcagacaacgcgcctggtgcccgcccctcaggaccggacgccgggtgtcgtggggtgcctaggacccccgcccgcttccgtcgagcgcccgcccccggcttcccgcgccggctccagcgcccccgccgctccctcccgcagccggccccgctcccctccccgcccctcccggcgcgcgtgcgccccgtgcccgcgcccctcccccgccgccgtgggcgcgctcgcgtgcccgtcgtcccgggcgggagctggagacggccagcggctgctggacgaagagcgggcgccgggagctccgagagcgcggccgggcgaggcgggagcgcgggcgctggcctggccgcgggcgggggccgccgccgcgccgctgcccccctgtcgcgggccgggccgcggcgccgagcgcgagggccgggctcccggggctggcggccatgggcaggagccggaggcggcagcggcagcggcgggccccgcgggcggggaggcgcgcggcccacggcccctgacggcccctggcggcccggcgcgcccccgcgctccctggggggccgtagcctggcaacgcccggcgcgcccgcccatcccccgctgccctttttctcctggccgggtgcgagggagcatgcccgcgcctggcctcggccagcgaagagttaacctgaggggcgagccgctgcccccacctcgggggcgtgcccccctcccccgctaggcggcccgccccccgcgccagggtatggcccctggccccggcccgggacccgaggtcccgcgcccgggtcagtgaaaggcgtcttcccgttcccgccctccgcctcctctcgccggccagcaacatgggatgtaatatgtgcgtggtccagaaaccggaggagcagtacaaagtgatgctgcaggtagggccgccggcgctgcggcgggggcgcggccctccgcggggaggagcgggccagtggggaggcccggagcggcgggcgtgggagagcgggagggctcgaggaggacaaggtagggagccgtccgcaccctcccatcctggggctgttgggtgttggcgctccgtgggaaccagccacgggtggggtgggaagttggggttggcccgggtggggcgcgcttccgtcccgggaggcgcggtgcggcgggcgcgggatggaggttgcatagcaacgagcgcagttccccgcacacgctctccccgcaggacccagggcgggggagggagccaggctcccgccgtgcggggggcgccgaatctagatcccggcgggcctggagcgtgggagtgcgtgggcgtccccgggcgcggtccaagtccgtccgggggctgggtgcccaccccgacacccactcccgcctggccctgcccgaacgatgggctcccgggccttaggcgtctcgggtgagtgggcgccgccgggatcagcgggttgggctctctgcgggtggcagtgcctggccgggctttgcggggcgtggaccagcagggccccgcggggagggaaggagacgcggggcccggagctcggacctggagcccagccccgcggcccggaacggggcttcttgcctgtgcgtggcgtgactacgtgagtgcgttcctgtgccccgtctctgtgtgcgcggaggctcccccggccccgcatttgtgtactttctgtgtgcaccctgcagactgtctagagaaatgtcccggatgctgtgggctgagacctcctagggctaagtggagggaggtcaaggtcaaggcacccaggagcagacagggctcagacaggtatgcgtttagtggcctggattcaactcccgggtttattggtctggactgggaaggaatcaagtgctttgcaggaggggtgttggcttgggagaacgtgggggaacccgtgcagggatcggcgagaactccggggcgggggcgggggcgggggaaggaggggctgggcacgggggagaattcccaggaatccggggactgacttcacgctgtgagccgagctcctctggccacctggtgcgggagccgaggggcagggcggggacgcaaatcttgccccaccctggcggagctcctggtcctctctccccggcccttctccgggggtgcgcggggccctcggcttctcccgttcgctgtcctccgccttcttccctctcagttcccggctgccactcctcgtctcttgttcccgctgtttggaaaccttgtgtggccattgccagccccctagcgggataggaatgcgaccgagagggcgtcctgtggaatccgtgttggattccagggctgggatggttggttgacggggactctggatcccatcctcctgcttccttttcgggagtcattccatcaaacggcaagcgatttctccaagcgattcctccggggccgttttgactttcctggagaaggattggtgtcgcacttcatttaaggccaacctcgtggggacgtgtggataggggagagcgacccgagctgcaccccaggcctgaaatgagccatgggacgacaccggtagcccttggggctccccacagccctccgggaaggcctcggcaggtcgggctgggcctgccttcagggaggtgaacttgggtgggccctccctgctctgcgccctaagctctccttcatggaagggacttgcccaccccaaggagacccgccaggaggagggccactgccgcatgcgccctctgtgcgctttcctgctgggctccctttgaaaccgtgggagtttggctgcaaactttcactttctacattcctccttggcccaatcaaagccgggattttacgaggagaaccatccttcacaactaagggaaaacaagaggactgaaaaaagtagatacggaaagcagtgcaagccatgagctgtcccaggggactgcgcttctgggggtggacgcatcaccaggtcccagcctcttcagaggagaaggagcttttgttccaaaagacaggtcagcttctgggaccccgtgcctgcctcccggcctccttaaacacgggtgctcccccatctttagggggcacttctccctgtcccccctgagtaacctcgtccgcaccttgtcagggtgaggcacttcatgggcctgattttcagaaagaagcacatgtgcatctgcagcgccttccatctacaatccacagaggcctgggatccccaggccaggaacccccaagtctctagcctagccttgtgttccaagccattttctgccaatgactcacaacacttccaaaattacagctgtattgagctatcattctcctactgcacaacttaccctttcaaagtgtacaagtcagtggtttttagtatactcacaaggttgtgcagcccacaccagtaattccagaacgttttcatcaccccaaaagaaaccctgcactccttagcaatcacatccccatttctccctcaaacttcctagcccctggcacccaccaatctacttcctgtctctatggatttgtttattctaaacatttcatagaaactgaccttttgtgtctggctttcattaatcataatgttttcaaggttcatccatgtatcaatagtcaatttctttttattgccaaataatatttcattttgtgatatacaacatatttatccattcgtcagttgatgagcatttggggtgcttccacccttgggctgttgtgaatagcgctgctgtgaacactggtctacttgtatctgtttgagtccttgcttttaattctttggagtgtgtgcctgtagccattgaactgttttccacagtggctggaaccagtttacattcccaccagcaacatataagggttccaatttctctatatctttgccaacagttgttattttctgggtttttgttatggccgtcctgctgggtgtgaagtggtatctcattgtgattttgatttgcacttcctgttagctaaatgatgagcaccttttcttgtgcttgttggccatttgtggatcttctttagaaaaatgtctgttcttaagccagcgccacactgctttcattactgcagctttgtagtaagttttgaagtaaggaaatgagagtcctccaactttgtacgtctttttcaagactgttttgtctattctaagtccctcaagtttccatattaatttcaggatcaggttgttaatttctggaaagaagccagttggcattttgatagagattgcatcaaatttgtggatcaatttgggtagtattgttcatgagcatggggtgcgttttccatttatttaggtctttaatttctttacatgatgttttgcacttttgtttaagtttattcatgagtattttctttatgatgctatcataaatggaatcgttttcttaattttactttcagccttctcattgctactgtatagaaatacaattgattggctgagcgtgttggctcacacctgtaatcccagcactttgggaggccaaggcgggtggctcacctgtgcttaggagttcaagaccagcctggccaacatagtggaaccccgtctctactaaaaatacaaaaaaaattaacggggcatggtgatgtgtgcctgtaatcccagctactcaggagactgaggcaagagaatcgcatgaaccccagaggcagaggttgcagtgagctgagattgcaccgctgcactccagcctgggtgacagggcaggactctgtctcaaaaaaaaaattgatttttatacattgatcctatatcttgcgaccttactaaaattgtttattaagtataatttgtttagtagattcctcaggattatctacatattaggatcatgtcattggcaaatagaaatcgtttttcttcttcctttccaatctggatggctttgatttcttttcttttctttctttctttttttttttttttttgagacacagtctcactttgtcacccagactggagtgcagtggtgcaatctcggctcactgcagcctccgcctcccgggttcaagtgattctcctgcctcagcttcccatgtagctaggattacaggcacacactaccacacccagctaatttttgtatttttagcagagacgagcttttgccatgttggccaggctagtcttgaactcctggcctcaagcaatcctgcccgcctcggcctcccaaagtgctgggattaccggtgtaaaccaccgttcctggcccttcgatttctttttcttgttaatttgctctggctggagtctctagtacaatgttgaatagaagtgcctgtgaatgtctttcccttgttcctcatcttaaaggtaaagaagcttccagtctttcactagggggtataaagttagctgtggctttttcatagctgtcctttatcagggtaaggaagttcccattctattcctagtgtgtttttatcatgagaggcattggattgtgcagtgctgcttctgtggctagtgagatgaccacatggttcctttattccacggatgtgggttgtcacaggcactttcgtgtgtcatgtcggaacctcagccccattcctatattccaatcatgtcctcctagtttggaaaatctgggacctcccctgaaaatggaggattactgcgtgttgagttaggaaaaggaagcaggctggttgcccagaatggaaggcaggaaacagcatgtccccagctccggagccttttctgcagcccatgtccctccactgccaccaggcccccttgtcatatatctcatcgtggtccacactctgctgaacttgtcttggccttggcaccccctctctgacaccatgatgtgcttgctagcatccgagcacgccggagatggtcaggggataaacccctggtacttaggactggtctcccgcccatcctactcaggctttacagggggagtgggtcaggaccgcctgtcatctcccctctgtccacatcgagggaggccaaaggacagctggccagcccttctggtgatctcccaggcattcttgcctaaagcacctgcatgtgagcccccatggtgctggcagccatcctgggtgcgtggcattcagcagggagacactgcagacagggccttgcccctcccccagactccccttttgttgttgttgttgttgttgtttgagacagagtttcgctcttgttgcccaggctggagtgcaatggtacgatctgggctcaccaaaacctccgcctccagggttcaagcgattctcctgcctcagcctcccgagtagctgggattacaggcatgcgccaccatgcctggctaattttgtatttttagtagagatggggtttctccatgttggtcaggctggtcttgaactcccgacctcaggtgatccacccacaccggcctcccaaagtgctgggattacaggagtgagccaccacgcctggccccaggctcccctttttgtaagggggagaccatcgccaacatgtaggcaactgcgggggagagaaagtactgcttgagtgcgggagcgtggctggcagccagtgtcccctcttcagcgacgtcttcctccaaactgctctcccacccaccaagccaggtggcttctctggctccctcctgcttgcatgggggcttcctgtgagcagggatttgggtctggcatgggcactctgcctccccgcctcaccagcaccagatgctgccagcacatccacgctggcctccacccttccaggggaaagctggactctcagtcaactcagtggttctgccgcagaagctgactggggaagaagcaggctctgagaaagtccttgtggagtggaagaacagagggctggacactgaattctgactgccatcttctggaccaggtcatcctgttttgtgtcattgtcccaagattgtagaatgccctttcccctctcatctcggggttcctgaggactgtccagtctgctgaaatgaaattcgatagtgccagagagcagattcgtggttgcagggatgggcagaggggcatgaggacacttttggggaagatagaaatggccactgtcctgacggtggtgatggttccccaggttcatgtatgacatatgaacacctgccctttgcacactgaagatgtgcaggttaccacccagcaacagacctcaccaaagctttagaacaggaactccatggccacatgcacgcatcctggggagaaaggtgtcctttccttccttctacttcaggggccctgccagagaaggcagtgcagtgtggagataggaatggaggcagccaccaactgacagctgtgtggccaggggcaagtcgctgcatggcccactggctcagtgactcagtttcctcaactgtgaaatggcagtgaagagtgcttgcgtccgagggccattgtgacaaggaaaacagatggtgtgtcccccgggatctcactgggtggaggagggagttgctgccctcgggccattcagttggtcattaagaagtggaaattggctgggtgcggtggctcacgcctgtaatcccagcactttgggaggccgaggcgggtggatcatgaggtcaggagttcgagaccagcctggccagcatggtgaaaccccatctatactaaaaatacaaaaaattgaccaggcgtggtggctcacgcctgtaatcccagcactttgggaggctgaggtgggcggatcacctcaggtcaggagttcgagaccagcctgaccaacatagagaaaccccatctctactaaaaatacaaaattagccgggcatggtgacacatgcctgtaatcccaggtacgcgggaggctgaggcaggagaattgcttgaacccgggaggtggaggttgtggtgagctgagatcacgccattgcactccagcttgggctcgaaactccatctcaaaaaaaaatatatatatatatattagctgggcatcatgcacctgtagtcccagctactcgggaggctgaggcaggagaactgcttgaactcagcaggtggaggttgcatgagccaagatcaagccactgcactccagcctaggtgacagaacgagaccctgtctcaaataaataaattaattaaataaaaaataatgaaaaaggaaattatatggagaaggccttacatctgggtatgtcacagttaatgcccagtgacagaagaatgtccaatattattctgagaatttctctcaggaaagggacctccaagttttgaagaagtgtgatgtagtacaatattagttaggacagcctgggcaacatattgagaccttgtctctacaaaaataaaaaattgctcaggcgtagtggcatgcgcctctagtcccagcttctggggaggctgagtgggaggattgcttgaacccaggagttggaggcttctgtgagccgtgattgtaccactgcactctagcctgggcaatggagccagactgtgtctggaaaaaaaagaaagaaagacagagagaaagagagagagagagagggagggagggagagagagagagagagagaaagaaaaaacagatggacagggaacaaagcggaggcatatgtggtcattttgcacaggagttgggccggaggaggcgaggctgagcagcctggggctggacaagatgtcctccctttcagtgcattctgcctgtcctcatggctgcttggagcattgagaatgaaaaacgctgcagagggaatattgctttgattgtaaaacgctgcagagggaatattgctttgattgttgctagatgtgaactgtgcccttagccagtcaggttagcctgaggtgggtgggaggatgggtttagttgctgggccacgtgcctggaaagctgtgaatatgtacccgaaggttgatcttgagaatggcttcaggaagtggttggcttttcctgtgcaaggtgtgggacacccctcttttcctgtgtgttttttttttttttttttttgagacagagtcttgctctgtcacccaggctagagtgcagtgttgtgatctcggctcattgcagcctccgcctcctgggttcaagcaattctgcctcagcctcccgagtagctgggattacaggcacctgccaccacgcctggctaatttttgtatttttagtaaagacagggtttcatcatgttggccagtctggtctcaaactcctgacctctagtgatccgcctgcctcggcctcccaaaatgctgggattacaggcgtgagccaccgcgcccggcctcctttctgcttctgagccaggactatggaggtgtctgagaggccgccgctctcccggaaaggtgggggccaggtggattgatgagacttcagcagaccctgggcttcggggagggaaggagaagtgaggggaaagaaagatgccctcatgcagaaggccttcgttgaggtctgccctggttcctccagggcgcgctctgagtcagtacagcgccaccctccacccgaagtccttgttaaggtgcactttctgactgagccactagcatggggcctgggattctgcacttctcacaagctcccaggtgatgtggatcccactggctgtgagtagccagggccttgggtagggaccgggagtagatctatggtagccccaaaccacattaacatgggtggtgaagtgaggtgttgttttttttgtttgtttgttttgttttttttttttacaaatagagggtaaaaattgtttacaaatagagggtaaaaaaacacacatagagggtaaatcagaacatccaggagtcgttgcctacgtgagggctttacaggacataacttgttcttccctgccatgtgcagctaactgacccccttccctgtcaccggcacccctaccggtatacatgtctctcatggacgcccagacacccctcccccgactaagtgctcaaaggcctttgagatgaagccctcccatgtttctgtctctcctgcccccaggcagaaagggtgggcacagagttatggaagcgggtggtgtggcttgcccaggaggccacagttgggggcgtgggcagccatgctacttgccgggcctgtcacctctttgtccctgctagaattctaacatgttggtggagacattttgcagccaccaatgcagtaattaattcaggcaaaaatcatcactggatgccaaaaccattagatgtaaggtcgttggggacagaatattcacaaagtctccaaatattaccccaaattacctgtgaatcaggaagggaaactgcgtctttacagaggagagatctggcagctgccacctggaccatgtgatcaaacagcctccccaacagtggggcagcctgaccctgccagccgccagatgcagggctggggaggagacatacagcatctcctgcaaggtgctcttgtcaaaacgctcagcctgaatctcaccgcgggaatgaatcaggcaaattcagactctggcgcattctataaggactggtctcttccaagaagtcattcccattaaagtaaaaaatatatatatttttttctagattagagaggagacataataactagagacctaacaaccgaatgtaatatgtgtgcttcttgattgaatcctagattttttgtttgtttgttttgtttttgagatggagtctctctgtgtcacccaggctggagtgtgatggtgtgatctcagctcacttcaacctctgcttcctgggttcaatcaattctcctgcctcagcctcccaagtagctgggaccataggctgcaccaccacgcctcgctttttttttttttttttttttttttgagatggagtcttgctctgtcgcccaggctggagtgcagtggcacgatctcggctcactgcaacctcctccgccacccgggttcaagtgattctcctgcctcagcctccctagtagctggaactacaggtgcaagccaccacgcccggctaatttttgtatttttagtagagacggggtttcaccatattggccatgctggtctcgaactcctgaccttgtgatctgcccgcctcagcctcccaaagtgctgggattacaggcatgagccattgtgcccagcctcaaatcctagatttttaaaaaaagctataagggtgttagcgggacagctggggagatgtgaggctggcccattgtatgagtgcggaattccgtgctaagggtgttgtggttccacggagaatgggactgatggcatcttgctttcaaatgcttctgcacatgtgtgtgtagaaaccccgagagcaggtgtggggaatctgcagatgttcccacatgcttgtgggcggacaattttcaaaatcccgagctggggaaacatgaatggggactttgctgggtcactgagtgggtgaatgtagtgagcctgcggcttctcctttctcctctgatgctctactcgttgggagatcccccgatgcctgacttggcctggaagctacagtcacaactgcttccaaggtgtcctggatactccagacggcagagctgagagccagcaggcaggtcagagctcggccccgggcagaggataacttcctgtctctgtccttccccagcttgtttcctactctacagcagtggggtaaggggagtccgaaggtggcagcccccccacctccgtggcagccacgggggcccctggaagtgatgtggcttcacctcccatcccgcgcgttgccagtgagagtgaaaggggtcgcaggcgccgtgtgacaagcacttgggattgcgagtctcccaggccacaactgttttcttagcctctccggcctctcttctcggcttcccagagattcctgatcagcaagagggcgtcgcgccccacccggctgtgcgcctgccaccgctgggtgcaggagggtgcctggggcagagcctggaaacagagctcagcctccgacggggttggcggggcgggcgggcaggagtcctgccaatacagccaccagcgtggcggcgccgggacgagtgtggtccgccctgctcccgcagccgcagccaccccgccgccgtcgcggcgcgctctttgtctgcggctccgggctcagggggcggggcgagcgcgcctggggctccgccctctccgcctagggcgccccgcttcccgcgtcccctaaggcccgccagtcccttgcccagcgggagatcgccgccccacagcgactgcccgtggggccgacttcgcgtcatgcctgcctcgcctgcccggtgttgccccctcccctgtccctgtgtcccccctcccttgcccgcatgtccccctcatgcggggaaagcggtgccagcactttccctggccttgcgaattgctcttccatcggtattcagccgcccctctgatgttcctgaaaacccaacctgctccttctctgcaaaaagctccggaaggctgtgtcgatgcaggtcgagcttccccacccggccccctcccaccttttagcaaatccagaggccccaccttcgccctcccctcccgggctccgacccagtgcattgagcagctcctcggcttccctcccgggactttctagtctctctccccaaccggctcagtgtcagggtgccccaggactctccttgggcctctcctgttcttgactacattcactccctaggtgagctcctccatctcatgcttttgctttttaaatttttatttatttatttttaaatttttattatttttgagacagggtctcagtccgttgctcaggctggagtggagtggcacaatcacggctcactgcagccttgacctcccaatgctcaggtgatcctcttgcctcagccctaccgcctgccccctacctcctccaccacttggggctacaggagcgagacaccacgcccagcttcatctcatgattctttttttgtttgagacggagtcttgctctgttgcccaggctggagtacagtggtgtgatctgggctcactgcaacctccacctcctgggttccagtggttctcctgcctcagcctcccaagtagttgggattacaggtgcctgccaccacgccctgctaatttttgtatttttcgtagagatagggtttcgccatgttggccaagctggtctcgaactcctgacctcaagtgatccgtctgtctcggcctcccaaagtgctgggactacaggcttgagccaccgtgcctggccgtcatcttatgattttaaataaagaaaaattcctagtttaattgaacagcaatggtcacatgccacccagttagctgacttgggcttgggccagacatttggagtggggcactggagatgtccacatgcctcgggaagttcaagctagagataaaaaccttccatttcctgccctgggcctaatccctgagtccttccttcctcggtcttcctcactgctgtgaggatacccctggtccttgtggtcctgtgtggcaattttatgttttcttgtggtaagatacgcataacataacatttaccactagtgacttttagtctattctcaatgttgtgcagccgtggccactgtctagttccagaacaggttcatcgccccaaaagggacctcatatccctcagcagtgactccccaggccccccttcctccaggtcctggcaaccattcgtctgctttctgtctgcctctttgccttggctagactgtgctcatgcagtcgtgtgtgccggtcgttcattctttttatgtcgggatgggtgtaccatgttgtgctcgctcatccattcatccactggtggacacgggttgcctccgagtcttggttactatggatactctgctgtgagcatttgagtataagttttctttgcatgcctgttctcaactatggatactctgctgtgagcatttgagtgtaagttttctttgcacgcctgttctcagttctttggggattgctgggtcatgtacataagctacacctaaccttgtgaggagccaccagactgcttccctggctgcactattttacatgcccagcagcaaggcgtgaggctccagggtccccgcgtcctctccaatactcgtgcttcctttcactgattccagcctcctcgtggtgtgcggcggtatctcactgtggtttgggtgtgtgtttcctctgtgcgtactggccggtgctgacgcgtcttttcctgcgcttattcgatgtcttcttcaagccctcactgtcccttgcccccagcccaacagcaggtcctggcagcctacctctaaaacccaagctgactctgaccacatcccaccacctctactgccacccctggggtcatgccaccatcatctgtggtctggaccactgccgttgcctgctggtctggcccttacagtctgttctcctgggagctcccttcgctacaaggaaggaagcatggctggtttcttgtcatcatttaggtctcagctcaagtgtcaccgacccagagaggctgtcctgaccactctacccacccaggcagctttgtctctgtcccctcccaccttccaaccaagccccttggggagcggaacgggatggggggtgtgttctggatccaccgtctctcccttcagctccttggcactcctttcctatggggcaccctgtccagggcaggtggggcaggattcccccctcttccctcatctcccgtgcttcccgggcccaccccccagcatctccagcctgcccgggagtcacatgtcctcggcccacagaatccccagcacacgccccacccacaggcctagccccagccctggggtccctggcaccccacctgccagggcccctcccctgccttgctcaccccccaacacacctgattgttggaaaggtcttcccatgcccaccacgaccccctcccactcatctgtgggcgggagagcttggtccctgccgcacgttgcccccctagcatccaggcccaccaccgagcccccgacaggcctgggagccccactggtgggtggggacccaccagctgggggtcttgctcacaccgaggggctgggggtggcggtggctttctcagggcaccctgccttgggctgcaggccgctgggtgggcaccggctccctcggaaggcagcgcaacccgggatcctgccggccctggcccccaccctgccgaccgggcctggggcgatcagtgccccagctcctgtcctcttctgctcagatgctgggttgggagatcaggggccacagctcggccactcagagccctttccgcaagtcttagagggaccagctgcggggtgtgtgcagaggggctgcgctgtggggagggcgcatggctcagtcctcctggcctgaggcccgcctagcctaagtggcctccaggacccatggccaggcccttctgcagccttccagaaagaaccagcttcccagggttccctggggaaggcctggggccacctcctctggaggggtggggcctgtgcttcattcctccttccccaggtccccttccaggccgccaggtcccctccccgacctggagcccacagccttgtaattaaattgtaaacgtccttgtaattaaattcatgtaatatccattattattattactgttttagactaaattacttagagcacattgactggatcaaaggctaccatgaacgttttcaagggtttttatagttattgacaaattcttctccagaaatttgaccactttacactctggggtaagattcagactaagtgtgtctagaaagggtgatggggtcggctgggaggaggaactgggcttgcaggggacctggggcagtgagtgctctcagtgtgcaaaggggaactgggctgtcccaagcaggatgtgagggccacttgggccacattcaggcagaggggccctgctaaggcttgagtcccctgttcagagcagggaccatggtggaaattaaggacgttcatgtcaactgtggttgagattggagctgcagtcctagagtcagccctcttgggcccatcttggcagcaaatcaggaaggaagtagatctgtgtgctgaagagtcgccatggggcacgtcaagcccctggctgagccgtggtgtgctcacaggctgctgcactccccggggcagcggagtgccagggacttgtattttcatctttgtgctcctccgcctcctcagtgtggcgctctgagcacttcgattatttgaaaggaaatgcgaaaatttgtacaaaatctattgtgctagcacgtgatggaggaggggtctttgtgaacaggctttgagggtttgcttggctcacagctcactacccagtcaacagggttgactgccacggggtgacctcgctaaggtgaagcatgatgcccagcacgtggtcaggatggcacgggagcactggagaagatgagagtcgctgggaacctgggcgaggggggacaaggggcatttgagtgggcttcaggtacgtgaagtgttgcaagataaagtgggtttcttctggattgttccaaaggagggaggttgctctcaatgaaggaaacattcaatagtgagagttttccgataatgagctcagtcaacaatccccactctccccatactagagaagcaaagtggatttcttctggattgttccaaaggagagaagtttgcacttgatgaaggagacttttttttggggggggggtggggggtggatggagtctgactctgttgcccaggctggagtgcagtggtgcaatctcagctcactgcagcctccacctcccaggttcaagtgattctcctgcctcagcctctcaagtagctgagattacaggcgtgcaccaccatgcccggctaagttttgtatttttagttgagacggggtttcactgtgttggccaggctggtctcgaactcctgacctcaggtgatctgcctgccttggcctcccaaagtgctgggattacaggcgtgagcctccgtgctgggcaatttttgtatttttagtagagtccgggtacatcagactcaggggctgggtcatgcctgtaatctcaacacttttggggggactaagcagatggcttgagcccaggagttcgagactagcctgggcaacatggtgaaaccccatctcttattattattattttttaaaaggtagatcagataaattacaggtccttaatatatattcaacaaattacagaaatatataaaattttaattcagccaagaaacatattaaagttttatcttcagcaaactgttaggagttgggatggaagtagaactcagggtgaagccctcttggggtttgttgtctaatgaaagggaggtaattagacaatcacacataaaaggctgagctccagcctgggtatcttgaggcctcctggacttgctgtagcatctggagaagtatggggcatcatctcgcatcacttagcaccagcactgccacccagccttgatgtgggtcctgttggcctgagcgtttttccttgaagaaggtattaaaagcagattgaagccgcctgtgcccacccatcccctacgcacttcatctgctcgcctctctgccgtgttttccaccaagtacatactacgaatgagcctccattatgtgcgcctccattaactgcacatgcggaataccaggaattgtttgttcgactgctggcagacctttgggctgtccctggtgtttggccactgtggccttcatgcccacatcctcctggtcctcctggtggtggttctgaagggcatctcctctcatctcatggctccaagtgcttgctagtgggtcccctttgccctgagcacctgttgatatcctttgcccatgttcttcttgagttgtttgtgtctgtgttttcttgttgttttgtaggaattctttgcatattctggaaaacccattatgaggtccatgcattgtaaggctctcctctgagcccgcctttttactgtgtttagggtgtcttttgtcgtctagaagttttacatctcttccattattgcttccccatttgaaatattgagaatttcgtctctatcccacaccataaagatattgttctcttgttttgctttgtccctgtaggtctttgatccaattggaattgcttggccagggcttggactaggtcttctgtcttggtggggcgagctcccagggtgtggaaacgtttgcaggtggggcaggagggagagtctggtgggaagcaagcctggggttggccatgttgagtgtttgtgccttttagagactggagtggtcgagtaggcaatccgagggttggggcattacaggggtggctttaccagtgtgctacctcaggatggttgggggtggggcggggaggcaaggctctgagcaggactggaagagctgctgtcatcagaagggccacagtgtggctccttaccatgtgcctggccctatacctctttgctcatggccccatattttcccaccttgttggtagcccttagcccttccccagaggggagctcatttcttccttgggggtccagcatgaccgatgaggaggagagagagagagagcgagaaggcttcaggagcccgtggcttccacccaaatacctgcctggctgtcacaggcgatcactctggttgctgctgatccgaggtgctgaggctgtgcccacgcccatccccctcttgacatcccagcctccgccagcccgcccagcaagcgctcctcagtttccatagcaacactgctgctcggtaatgattccgggtagaaaggcattcgtgcgttctctgtcatctctgtcacctgagcatcccactgcctgcttgctgtcctgccccgggagttcaggaagaaaccctgaggacagctccgagcccttctgcttgtgtgttggcttctcctcaagggcagtggtaaggtggtaaatgttcccagacaaaaagccctgatttggagcatttgccgatttccctggtgtaaatgctgccactatagccgatttcaagccaccactgcgatgtcactgaacttggagttgggggaatgcacacatagtatttccatctcccataccagatgtgaataaccccaaaagcacagatgacagaaaagtgtagtaagataattagacagtgatgtgttccgaggatttattgcctttgttgttaatatcattcagttacctgtacatttctacggttaaaataccaataatcgctgtgtttgacaactggcttccaaatttcccagcttcagttggctctagccactgctgctgagagtgtcgaggccattccatcatgtccctttgtctacagccttcctgaacccacactctgctgccgcccaccctcttccatcctgcctttctaactgtagcctctccaccaagcacagcatgccctgtcctgactgacattcttacggtcttccaacaaataccttcttggctgaaagctgtttcctttatagtatttgatccagaaattccacctcaagaaattttctccaccttgacaaccactggttacacaaagatttaagtatgaaaaatgtataaaatggaccccagaatgtgtctttgccacattctttataataaaaaatcaaagccacccttactgatgtgatgatgaacatgatggtccactggtgtgttggtgtggatggaccttaaggggcctgcagctgcaaaatggcacacatagaaaacagactggaaggaaacaggccgcatggccaggtgcggtggctcatgcctataatcccagcactttgggaggctgaggcaggaggattacttgaggtcaggagtttgagaccatcctggccaacatagtgaaaccccatctctactaaaaatacaaaaattatccaggcgtggtggtgggtgcctgtaatcctagctattggggaggctgaggcaggagaatcacttgaacccaggaggcagaggttgcagtgagccaagattatgccactgcacttcagcctggatgacagagcaagactctgtctaaaaaaaaaaaaacaacagctgggtgtggtggcacacacctgtagtcccagctacttgggaggctgaggcaggagaattgcttgagcccaggaggtggaggttgcagtgagccaagatcgtgccactgcaccccagcctgggcaacagagcaagactccatctcaacaaaaaaaagcccccaaaaaacaaaaaaatgaactgtgtttcttttataatcggacaaaactgattttgacaaaaagctcttttcagaatatgaaaattttggggagaagggagacatagaaaacttcaatgattatctacaaggacatagtcaaatagaaaaaaagtaatgcaggagccgctgctgaggccacaggggttccgaggacaagctgggctctcctcagatagctgtcttcccgaaaagactcgtacagcggtggttctactgtatcgcgggcactaagacaagattttgccgtcagaattgacatctctgtgagaaacccggggtgggaggtgccgccgtgagaatgcaggacagagagttcttctaaacttgctaatattcgcacaactcggaaaagcagagggctccgtgcaggcgcagccacctgcgcccatgcccagggcccttctgccctctcatctggcacaagctcccagcctgctccatccctaggcggactctgggtctcctcgccctgccctctctgtgctgactgggggctttgcttccaactgcaaaccagcctccctgggtcttttcttggccctgttccctttgcctgatggaggccaggtgtcccctgctccagaagccttccccgcctcccaccgaggcgtgcatggccagccgtgtgctcccttagctgtgggtaaggtctgtccccacgctcacctgcggggcatagccatttgggcataatgctagtgtgtagcctccccaggcccagaacagcccttccataagccgctgagcccatgaggagaccctgcacgcctgcctcgagctgcctcctcctagaagtgcttcctgctgacccttgctggccccatggcacgtgccctgaattctggtggagtctgttcagtccttcttggtccttagtcattcgtcccttctctacttgcctcccttccccaaggaggacttgaaggtcgcagcatactgtcccagggtgctgcggaagcagccttcgaccttgtgggcactgcttgccccaccacctgcgctgtgcgtaatgggcttccttctgctacccttcattgtccttccttcacccctacagcatcccgcagagctgcttaggtcctacttccgccttgggccctggcccgcgatggcctcctcctccctgacccctccttctggccaccgggcagcctgtcctggctcatgaccttgactcagtgccacaaccttgctgagcttgctgacatggtttcctcatctgcaataatggcatctccctcaaggttgttgggggttaggattttgtggagacccacatcaggggtctttcccagaatgtagcacatggcacgtgcccaaaaaacagtagtggcatttttttttctttgagacggagtctcgctctgtcgcccaagctggagtacagtggtgcgatctcggctcactgcaagctccgcctcctgggttcatgccattttcctgcctcagcctcccgaggagctgggactacaggcgcccaccaccacgcccggctaattttttgtatttttagtagagatggggtttcactgtgtttagccaggatggtctcgatctcctgacctcgtgatctgcccgcctaggcctcccaaagtgctgggattacaggcgtgagccaccgcacccggcctagtggtggctttataaggaccactttcttggcacctcttttaggctactttgcagttccagggggcttcttgtacatcaaggccttttctcttgggcaagtcagttgtcactgtgaggacacaacactgtatctttaggcatcttcctacttgtcccccaacctgaccctggccctccctagtgagtagacatttgttgagagactcggctcatctgaagagtcaaggtcatcctcttgcttgatgctgaatgagcacaacacagatgctcactgagtgttggctgttatggtccagtcattgccaaggaactcaatgggatcttcatgctagctctggcctcagtgccgccctagaaagaagtgggtccggatggggagaggccaggagagctcaagcagtgtctggaggacgttgtagggcggtatcacagcctccagacccagtgcacagaggctgggtcccccagtccttggtgtgacttggtgatccccagctggccttcagtgggatgaaggctgagcagtggggcttgcctgggaacaggggcaccaaaggtagccagggctgcagacagcagattccttgcttgagtggcttggggtgctggttgtcagcccaggtcctgccagctagggcctctgccttgacctcagaggggaggagcaagcctttgagggttcttacggaggcgtgtctctgccgcaggtgaacgggaaggagctctccaagctgtctcaggagcaaactctgcaggccctgcgctcctccaaggagcccctggtgatccaggtgctgagacgcagcccccgcctccggggggacagctcctgtcacgacctgcagctggtggacagtggcactcagaccgacatcaccttcgagcatatcatggcgctgggcaagctgcgtccgcccaccccgcccatggtcatcctggagccgtacgtcctctctgagctgtgagtcgccctcaggagggccccgggccctgcctccagagaggacaggccacctggagcggccatccgcacgccaccctctcgggcaggaagcaggcccctcggcctccagaactgaccgtggtacccaagggctccaaaacctccaggcctctagccttgggccgggctccagcaggcgccccgttgtatctacccccagggccgagggaggaccctcctgtccgggacgtcgctgccggaagtgccagggttgagggcctcagctcctcctcctccatcctctctcctctgccgcctcacaagcatcactccttgaatcttcttgcatcccttgtctgtctcattcctctacctgctctgaatttcctccatctcttcagcttctttctttggcccgaccggaagaagggcctttcatccaggcctggtggctcatgaccgcgtgagcgctgcctcattctgctaatcttagcccgggctgcggggaggtaggccacagggccatgagcagccaaccttagttttggggccaggagggcagcccctggaggtagggtgggcccccctctgctctgcagaagtcctccagggcctggataactcctgggggcgttgcatgagtggggccagtgctgggcgggcgggtgggcacccggagattggagaagttggtccctgccagctggcgtggttggaggagttctggtctgggggacgggaacgctagaggcatgcgcaggtcctctgcgtggacgctgcacactcaggtgcgagaagtgcccccggtctttgcatggctgcatgttgcccaggaaggggctctgcaggaggcaactgggccacccacccttgagagcacaagcagagcaggcctccgtgccaggcacgctgggatcggcctgcctgggagctggggctgaggtgtgagaggatggccagctggtctgacccccaccttctcctgggcagccccccaatcagccatgagtattatgacccggcggagtttatggagggcggcccgcaggaggcagaccgcttggatgagctggagtatgaggtgagccgggtggccaggccagggcccgcagccagctgcgggagccgccccgacgcctgtgtgccttcctgcccaggcccaaccccgtggccctcctggcacgcatctggctgagtcagggagggtgcgggtgaggttacgtgttccgtccatgtcggtgagtccacgtcccatgcacgtctgtcttctgtgtcctgtgcctgtgtgtgcctcgtgcatttcctgggagggagaccactgagtacgtgcgccacgtgggatggtaagagagaccctcaaagcggggcctggaaactgagctcagggggctccagaggaagctgaggggctgcgggctgaggggttgcgggctgaggggctgggctgtgctgcctgctccctcactcacgcatttctggggctttctacctctgcttcctcccggacccctcgtggcaggaggtggagctgtataaaagcagccaccgggacaagctgggcctgatggtttgctaccgcacggacgacgaggaggacctgggcatttatgtcggagaggtatgcagacgggtatgccccagccccgaggcccatccacatggcctgcctgtggctcagaggctgcccttaaggtcccagctaccagaaacagggcatcacagctagggtgctgcgtggtgaggcgatgatggtcgacggcttcagccactgtccagtgaggtagtcatctgcagaaagaggcctgtgcctgggtgggacagcagatgggcctgagaactagcaacagggttgctgtctagccttctcccgaacccatcttgggcagatgtcttgtgtatccccaggagggggatggcccctcgctcccctccctactagtagcatcccactaaagccacccttccagatggacaatgtcctacttcccaccaatgcccggggctgaccaaaagcacaggcttccgtgcagaagagcctaggagtgcagggcaggggcggggagaggtgactactccacagcctctgcctctgcttcctggggctcagagctggaaggggagccagagagccttcagcttgctttgggggcccctgaggtgagcctgcccccttctaccgaaagggcatgttaggcaccaagtccccaagatgcgtgtgtcctgcaggtaaatcccaacagcattgcagccaaagacggccggatccgtgagggagaccgcatcatccaggtgagcacttgcaggctgcaggcctggcccaaggccccgctgtgcccgtcggcccagccacctctctttagccagtccctagctctctcccactaagagctaaccctgaggcccagcagcctgccgtgtcctaaacccgggctgagtctcatctctctcctgcccactcaccccagtggctcccgtgtgcctatgggatctgctggcatccagggcccctgctgctctgaaacctcctggcccctctccctctgccccactccatgctctcctgagcacacatttgctcttgcaagagtcaggccgccctctccctggtaccttccacttagttacatcctcccagagctcaagccccagcctagcccagccgagcccagagtgcttgggctccctgcacccgcccagggtccgccccagggccagccctagcatgcttgttgattgtatcctgcctgcctcagattaacggtgtagacgtccagaaccgggaagaggcggtggccatcctgagccaggaagagaacaccaacatctccctgctggtggcccgacctgagagtcaggtgtgtatgcctggcagggcgacccggggccacgacatcaggctttctgtcttggaagctgctggccgtgactagggcacagatgtgccaacgacctggagttgatggagggcgggtgggcaggggtctctcagggcccgtttcccctcctggcctctgaaggctgagggggctgggacgctgcccccaggttgctgagcttcaccgaaacaagccaagtgcggggtccagagcagacaagaagggtatatggggaggtccttgaagctgtggggacaccagggcctgtctccacagctggcgaaaaggtggaaggacagcgaccgggatgacttcctggatgactttggctctgagaatgagggggagctgcgtgctcgtaaactgaaatcaccccctgcccagcaggtgaggaaggaaaagggcgctggtggggagggcgaggaggagagaactgggtggaaggcgctgaggctgtgcagggtctcccaatgcttggcagggaaatgaaccaggcctgaagccccttccgatcctcctgtgacatcccgtgacatccctgtccgtgggacctaactgagcggtacttacctttctgctctagcccggaaacgaagaggagaagggggctcccgatgccggcccaggcctgagcaacagccaggagctggacagcggggtgggccggactgacgagagcacccggaacgaagagagctctgagcacgacctgctgggggacgaacccccgagctccaccaacaccccgggaagcctgcgcaagtttggcctgcaaggggacgccctgcagagccgggacttccatttcagcatggactctctgctggccgagggggcggggctgggagggggcgacgtcccgggcctcacggatgaggagtatgagcgctaccgtgagctcctggagatcaagtgccacctggagaacggcaaccagctgggcctcctctttccccgggcctccggaggcaacagcgccctggacgtcaaccgcaacgagagcctgggccacgagatggccatgctggaggaggagctaaggcacctggaattcaagtgccgcaacatactgcgggcgcagaagatgcagcagctgcgtgagcgctgcatgaaggcctggctgctggaggaggagagcctctacgacctggcggccagcgagcccaagaagcacgagctgtccgacatctccgagctgcccgagaagtcggacaaggacagcaccagcgcctacaacactggggagagctgccgcagcaccccgctgcttgtggagcccctgcccgagagccccctgcggcgggccatggccggcaactccaacttgaaccggacccctcccggccccgctgttgccacccccgccaaggcagctcctccaccggggagccccgccaagttccggtccctctcccgggatcctgaggccggccggaggcagcacgcggaggagcgcggccgccgcaaccccaagacggggttgaccctggagcgtgtgggccctgaaagcagcccttacctctcgcggcgccaccgcggccagggccaggagggcgagcactaccacagctgcgtgcagctggccccgacgcgaggcctggaggagctgggccacggccccctgagcttggccggtggccctcgggtgggcggggtggcggccgcggccactgaagcaccgcgcatggagtggaaagtgaaggtgcgcagcgacggaacccgctacgtggccaagcggcccgtgcgagatcggctgctgaaagcccgtgccctgaagatccgggaggagcgcagcggtatgacgaccgacgacgacgcggtgagcgagatgaagatgggccgctactggagcaaggaggagcggaagcagcacctgatccgggcccgtgagcagcggaagcggcgcgagttcatgatgcagagccggctggagtgcctgcgggagcagcagaatggcgacagcaagcccgagctcaacatcattgccctgagccaccgcaaaaccatgaagaagcggaacaagaagatcctggacaactggatcaccatccaggagatgctggcccacggcgcgcgctccgccgatggcaagcgggtctacaaccctcttctctcagtcaccaccgtgtgagctgcccgggcgggtacacggcccaggcccagggaaccccctggggccccggccctcactctcctatagagattgtgtgtgtgtgtgtgtgcgcgcgcgcgtgctcgctgtgcgcacgcacacatctcctcgtctgggtgtgcgcacagggctttgttagcagagagaagcccctgaggagaagggacgcttttcttccttctgcccaagtaaagtgaccatgccagtggccagcactgggggcacacctgtgatgggcaccccttcagctgtgcgtgtgcattccccatcccccatgctcttgcgtgtgcttgcacgtgcacgcacacacacacccagtgctctctccacccgacccgtgtacttgcagacagggaagctgagctgaaaggagcacaagagagtgtccggcttcgctgctgagcgcggcctctccccgccgctgcgcactgcagttatttgtagacaaaggcacccctgatttttgtggtttttctccctttctgtgcttgccaatagttgttttgttttgtggacctgccctgggggctggcagctccttcaggcagcctggcagaagtggaactcccctctccactgatggctgggaagggagttggggaggaagagtgggagggagggctggggatggatgggagggaaggggagggaaaggtgggaggaatgggaagcagctgttctggtggcttccactctgaggtgtgggaacggggagcctctggggggcacctgtttccccagtgactcagagagagcaagactgcaggaacggaggggtcctgcagggtgtccaccaagaagtcacagagcccgttctgcgccccacaccatctggagcaggggcttctcttctgagtgaactgaggaaggtgcttagatggtgagggctctagaaaccaagccccatgagcagcagtggaagacctcgggccatgcggcctggggaggacttggtggcgatccgcaacctggaccccagtgagaggcggtgggctgactgggaaggagaggcccccaacctcctcaggatttgcacgtgtgaactaggctgcctgtggggtgccccttaggcttggagagccccagattggaggcagacagactgcaccaccccttccccccctgcatctcaagaataaagcaagctgcctttgtacttggttgaatcgtggcctccctgtgttcattcttattgggctggggaaagagttgtcagtttggggtgggagaaggaagaggggggcagggttagggtcaactgaaagccacgctgcagccctcggtttgtcttggatgtcaggagcagtgactgtgacctcccatggacaattgtgtggcactccaggagatataccagagtcgcctgagtcatttcagaggtgtcacagtcacagggtggtgaccagatgcagaaggctggcagaagcctgacttcagactagcctccaggcaagggccacggtcatctccatgggccaaaccgtaggtggggcccgctgctggcacatgccacagagaagtgggttccagccccatccctcccagcagggcctgatgccgtccactctggaaggcggaagctgccctccccatttggtgatcccacagtgcctagcaaggtgctcagtttgcagaaggcacctagtggatgtcttggccagatagatgaataaccgcgtcgttgccagggcccttccatcctgggagctctcagcaaaccttcgggctctatcaagtcctaggagccatgctcaatgctgggcagggtcagggcctcaaagacaactccgcagaaaacatgggcacagcctctcatgggagtggcactccctggagtgggcagtgctgccatgaaggagcggaagtggtcaaggaggcattcaaattctccagaaagaagacaatataggccaggtgcggtggctcacgcctgtaatcccagcactttgggaggccgaggtgggtgcatcacatgaggtcaggagttcgagagcagcctggccaacatggagaaaccccgtctctactaaaaatacaaaaattagccgggcgtggtggcaggtgcctgtgatcccagctactcaggaggctgaggcaggagaatcacttgaacccgggaggtggaggttgcagtgagtcaagatcatgccactgccctccagcctcggcgacagagtgagacccccgtctcaaaaaaaattttttttcgtttaaacttctcttaagtgccgagatcggggcagcaagtcagtgacggattagacgctaagaaggctgtggggggaaaaagtcccagtgcctgttcccagaagcctggagtcccgctgcagggaaggctggatcacaagggtgccagctgcctctctgccgcacagcagctctgggagggaaagcctggcatatcacaccccaccagcagggaagaggggaagaggcttgctggctggatggcaggaaggggagcagagggcagaggctggagataatggcttcccccacccctcagggcctcacccccatgagggcttggcacatccaacccttgaccagctccctaaccctgtcccttgggggaacaaggctccaagggcccagccacagggaattggccggagttgactggagatggaggtcaaactgtccccttggcctccctctagctgctggggggctcacttggatggtcctaaaggcaccccccttcttccaatggtggggtgccctccagtgttcacgggatgtgggctcatatgggcctggagcctggagtcccttggctggctcagggagaggtggcgccaggaaggctggcagcacttggctactgatgccctggaatagcaacttcacgtctgggtcccacggccatcaggcttcgtggtggagccagaactaaaaagagcaaccgggcgcccgacagtcgccccggtgcctgctgcacccggcctgccccagccacccgccctgcacaggctgctgagtctcctctggaatctagaaactgcatctgctggcaaagctggtgtggcccctcagccccaacgctcctgctgcactgtcctggggtgagcgcccagctcttcctagaagcccacctattcttggcagccggcccctcccaacccccctcccaaggcctgggggtgggaagagggctccctgcttatatagatgaccccctccccgagactctgacagacccaggtcacaggcagtcctcacctgctcctgacacccccggcccctcagtgctgctctctctagccaccgagctgaagtactgaggagcccctacctcccaggcaagttttgggccttccctccttttcagccttggctgagcgcggtggctcatgcctataatcccagaactttgggaggccgagatggatggatcacctgaggtcaggagttcgagaccagcctggccaacatagtgaaaccccgtctctaccaacaatacgaaacattagccgggtgtggtggcaggtgcctgtaatcccagctactcgggaggctgaggcaggagaattgtttgaacctgggaggtggaggttgcagtgagctgagattgcgccattgcactccagcctgggcaacaagagcgaaactctgtctcaaaaacaaacaaacaagaaaaaggcagcctctctggagaattccatttctctccagtaacagccaatgggtgacccagatgtcaggactttggtggctggtcccagtggactccctgacaccttggagtaggcactgtcactgcctcgcagctgagcaaaccgacttgggtcccatggctgggaagggctcacctgggatttccacccagtccctttggactccaagaccctcactgcctcatgggccctcagtgccactaaggaataccattagctggtcaggagccagcatgtgccaagctgaaaatcaggctgatgggagaggtgcaggatgaactccaggcgtggtgccaggccgggatgcctgcctggtgtcctgagggcgcgggtgctcttgggagaggtgtctctaggaggaagtgatgtacccctcacaggtggggttttgtttttttcttgagacaaggtctcacactctgtcacccgggctggagcacactgctgtgatcacgactcactgtatccttgacctctccaggtcaagtagctgaactacaggcgcatgccaccacacccagctaatttttctattttttctgtagagacagggtctcaccatgttgcccaggttggtctcagactcctgacttcaggtgatcctcccacctcggcctcccaaagtgtggggattacaggtgtgtgccaccacacctggccatgggtgtgtattttctcaatatcccatgaaggcacagcacacgggaagccaggtggcatggtcagggtgtggagtatggaggggccaagcccagacagctgcacgccgcatgggcagggtgggggcacttgctgtgcccgaaagcagtgcagggaaacccctctgcgtgcggaatgggcccggggcttccaacacaggagctgtgatgaagaccaggctggctgtttccccatggagcctgtggggccacctggggaggaggtggccaagcccactgccctcaccagaaccaggagagagtcactgggaaggtggatacagggttttgtggggaccagacggggggcttcattgggaggagggacgggagttctagaccaaagcccacccctttcctgcctggtgcctctgctggccaggcagacaagaggacgctgggcccccagctctcccagtcgggggaaggcacaataacgcaagccagcagccccaggtcctgtgcagtcccaggtcctgtgatgtttattgaaggaagcaagggcagggctggggtgccgccctcaggcctggatgtggctcttcgcactgaaggccaagtagtagatcacaaggccgatcgccgcagccagcacctcagtggacacccagggcccgttccaagtgccctgaaaaaaaggagatcacaagccagctcaggggagtacaggtgagcagaccagccagccctggtcaccttccgccaggggaaccaagacatgctggccaatcacggcccagcagcagagctggggctgtggagaggataaccttcactcagcccaacaaccccaaaaaggaggagggaccaggccactcacccgatggtccacgctgactgtaaacagaggcgggatgatggaaatgtcctcgttattcctctgagcctgcaagggaggtgcaagggaggtgctggggtcaggggtgcctggcgtgtgggggtggggaggggaggggaaagacaggtaggaacaccggcccaagccccagaaaaggaaaggagagaaatgggcaagagacactgaggaagggacaggatcacagaaaggccacccagctcaggacttgctgccagcacctcccaacccagcccatcctgctccccagggacaggggagcacagtgggctacaggagtcctcaccttcctgaggaggctgtaggactcctcgtcgaagaatctaacctcataggtgcctgcgtgggcgctcttgtggtccaggctccaggacacctgggttgggtgttgagcagagtgtgggcagagtggacacggaggggccaccctgaccaccagtgccgacactgcagcactccggcagccagagcccacggcccctggccctggttgaccggccacccctggggcttcaggtcacacccgggagcagggagccccctagcaagggaaccattggcccctcacctgataacgccccacatcctggcctcgagtgacagggaattgttttccaccgacgtcagcatagagagccatgttctgggtgagggaacaaaggcagggtcaccttctgccccctctgggtgtgggcagaggagccctgtgcgctgctcacacggcctgcaggtgggcaggctaggcccagttgggggctgcagtgtccctggcaggaggtaccaagtaacactcaccaatcccgtgactggccctctgcattggtcttccctacgggggcacaaggccagatccccatggccgggcctaactggacgcataggaaccctgttgactgtgagcaggggcgggatgatcaaaagggctgagtgatttcctgagtctacaagggaggtgctggggtcaggggtgcccagtgggctgcccaaggggtgctttaccctaagagggccatacccaaaaaaggccccatttccttctttggacttatgggaacttagctgggcatggtggcgagcacctgtcatcccagctacttaggagactgagaggagaatcgcttgaacccgggaggtggaggctgcagtgagccaagatcgtgccaatgcactccagctgaggcaacagagtgagaccctatctcaaaaaaacaaacaaaaaacaaaaacaaaaacaaaacacccacacagacaaactggccaatggcaaccggggtgggctgactcctggccctttctcccggtccagatactcattcaggaaacagcgggtggtgagcccagggttacctcgtgtaggcacagcacacaaagcaggtgaggaaggtgacctgtcaacactggctaggatctggcatcaccgtgccctgatctctccggcaccccaagagttggaatcttgattctccctctatcgacacaggtcccccatcaactagcagtgaggagcaccccccacccgccctcctgtctgaaaccccactgtctcacctggaccctgttcttgcatgtcagggagatctccacaatgaagacggtctcagtggaaatgacagcgtcagaagtggtgtagtaggaaggggtgatctggggctccaggcaggcctcggctgcggggaagagggagagatgcctgggtaaggccagctcgagtatcccggtctgagggcaggatggcccggccctgcctcatagcacggatcagctggggacccatgcgctcttcctgccccttccaggtgggatatgcgagacagatccaagtgctcggtcacaaatgcaatggcaacgtaggcgggatggctgtgaaggaaggctggggaggggcaaggccggctttctggaggtgtgcaggaagagcgaactggggacaggtgggggctggattcactggacaatacatgccaacacttggacctatgacacggaggcccgggggccacgccagcctcaattcagagccacaaacggcctggacgagttactgaaggcatcctcagcagagacatcgggggtgggggctgcaggcaggcaatgcactggggctttcaagatgagagaaagggtctctgcccccggccagttgacagaaggtgaagactggccccagcgtttcctgaagaagtaaacgggagagactctggttccagaagcacaacttgttagctgtgagagaaaggaccttgccttagccttctccataaccagaggcccaaaggaaaggaaggctgccgcctacatcagagggtgtgaaacaaaggctccccaaagtgggaatgttctcagccacccgctgtccaaatgtggtgccctggcagaacgatggcttcagcagaggacgtcagagaaggctctgggtctggaccacaggaggcagatccctaggaacagcgtggaggcagttctcaggggctagatcccgccagcccttctgtgtcctgcctaagttgggcctgcttcctgtggcgcaggggagcccccgaagggttttatggccaggcttgtcctctggatacgtccctgactatagttcagggaattcctgaggggcagatgaggagtgtgcggaaagggaggccagttaggctgccaaaacgttgcaggcagcaaggctactggcctgaaggacggcagaaaagggaatgtggagaaagccgcccctgtccagtcctggcccccgggcccggggctggctgctgcagccacctcctaaacacactctggagttcagacctcagcccctcacgaatgcaaatcgacgggacccctggtcggctctgccgaaaactctggtaagggtaaggcagggccctccggaaaagccagtcttcggcctggcactcaaggccctgcgcacctttggctccccatctaactcgccccgctcttgctccctctcctcactgaggtcccttcctagcttatgtggctcctccagccccgtttttggccgcgatcgctcagcgctacagagcttcgctccggtccgaccccgcagggagcgggagccgggacatgtgtcacgttccgtgctgcagcttgggggccgggcgcaccatggaggctcggggactcctcttcgtatgggcagacaaggaaaagcctggctgccggtaaacgtgcgcgaggtgctttggtccccccgtcccaaggccgcctgcctctcgggggaaggcccggcccgcagcgacggaccctgaaaggccggacccccgcatccctcctgcccccaacaccacctgccgtgggtcagaggctcgcaagaaagaagccccggctgggccgctacctgagcagcgggagaggctggacagcaggagcagcgccagggcgccgagagatgccatcgccgccatcgcctcttctctgcctagaggaaaagaaaacgagctcccatgaacacgaggggcaaacgaggaagagcgacgcgtaagtggcagcggcagccaatcgcgcaccgaacggctgggccggcattgtgacgtctctggcagcactgacgtggcccctccctgagccaggggcccagctggtcgcggtccccccctcaacatggcggcagcggtgctctaggcgccggaagggggcgtgaatcggtgcgaccgcgcgcgtgcgcagtaccgggtccgcgcctgtccccgaaacttcgcaccccgtcgaactctcgcgagagcggtatctgcgtgtcgggacgtgcggaggctctcactttccgtcatggcgctgaaggtagcgaccgtcgccggcagcgccgcgaaggcggtgctcgggccagcccttctctgccgtccctgggaggtgagcagggaaagagccacgggaccgcggcagcggtcgcaggggagcggtggggtagccgcacccgaagcagtctggagtccgattggctaggggccccaccaggggcggggaaagggcttcgcgccggggttgattggccgcctccgctgtcactgaggggattggccgaagttggccctggaccggctcccccagggggtctgcatcgggtggcggggggccctccggacgggccgggagagtgggccacggcggctgtcacctccttagtgtccttgaaggagcccttctgaggcagtcactcacgtatcccggcccgcctttctcaaaccgcttcgggaatccggttccgggactcaaatttctccacggtttcctctctcgtggaccgctttgccacctatcccggtggcaaagaaccggactttgccagtcatcccccatagtcccccagtcttagagccccagatgccttcccctcgaggcgcctggaatgggaaggagctagggtttctgaggctgcgggggttttgcttctgctcttctccgtgtgcggtcttgcgtattcaggtccgagtcttctttccttacacttatttaagaagaggttaatttaggtcctaggtgggctggaaaccatctgaagcagctgccagccagcacctggccctgatgggtaagaggtttgacctctaggccatgctcccacactgagccactgcgtggccttaggccatttcctcctctctctgggttctagtttcccctttggaacccagaggggaggagacttcatgttctcaaaggatcctgtcaactctgaccttccagaactccgtgactttgcggccactccccagggacatctctacttgccatgttttctccttctgacctctgggggagactgcttgtgcctaatgaaattctcttgacgatgctgacttctcccaccttgctgctgaaaggacggcagtatatagtggctttccagaggctctgatggctccagcaactgggctcctgtaggctcttggtgaagacatgtgtgcctcctccctgacctcccctgtgtgtgtgcctgtgtgtgcgttggggtgggagtaggggacagtgaacggtgggtagctgggcagtgccttgccctgagactgaccgtcctgggtgtgagaacccttacagaggaaccccaggtcttgaatcccactgatttggacgccataggaaaacatgcagccaccattgacacatggtccaacagaaatatgccaaagacagaagcctcagcaggcataagatgtggggtgtggatgttctttctttccatggaaccatgaaagggtgatgggagagcgggaggcgtgtacatattgcatcctgcctcacacttggctcctttgattggtggcttcacagggaagtcagggcacaaggcagagcctttgcgacctcctgaaggaaggtgcctgcatctgtacagtaaggtcagggaagtccatctggagcgctctctgggtcttttgccaaagcccaaaggaacacctggcacagggaccgggtggcagagaggttcagctcagccctggtggtgatgttgccatctgtgagggaggtccatgctctcaggagattggcttgctgccacagctgaagcccaggaggaactactgctgggagctgcaggggtccacccgtgacctcccagggacaccagccttgaactctgacctgaggggccagtggggtgaaggggcaggcgtgctgtgtggcactagctactgtgagcagctcacacacctcctgtcccctaatctttccaacagtcacggaaagtaggtacctccgttctgtgaatttcagatgaggccatgaagccatctcaagaagagtggatggtggatttggaccgaggcctccctagtctccagatcttttttcattttctgatgtgcttgttcactcaggaaatgttccttatgtgccagctctgggccaggtactgtgctgggtcctagggtgacagtattggaccacactgacttggcccctcctctcgggctcaggggttgaggagggagcaatgcagtgataacctagggaagggggtaagtagggccttagggtcccagctcagtagccttagggcatcagggaaagctccctggaggaaggtccatcgaagccgctttctgcgtgcttacaagagcccccaaataagatgatttcagatgttgataagcgctagagagaagacagaaaagtcccgacccgttgataagcgctagagagaagacagaaaagtcccgaccgtgcctgtgcttgcagatccaggtgccacacagatcagctgagctatcctcggggctctggtccttgtgggcaccctctcctagcccctggcttggactgatgagtgccggccagggacacacagacagggagaggtcagactccgcccgagcctttctggacttctagctggaaggcatggctctttggccaatggctatgatgcttctgccattggctggaacactttgctgctgcctggtggtcaagtggcagggcatccccaagtgacagggaagaccttggctctgccaccgtctcaggtgtgttctaggtggggcttcttccaggacagcaggtcacttggcacctggcacatttggctcaggcagctttggctctgaagctgtccggcatttccagtcagggcgttggggacattcggcatccagcagtcctttccgaaggccttcctagagttgggtttctgttatcaaccttccagaaatggctggatgtccctacacatttgttttcgatttctaatgccgaagggccattccccagggggccagcagtgcttgtctcagggaggccggaggctgggtgctaccttcttatctccctattctgctttttctgtagcgaccacatgctgcttttgtaataagaaaaagtgatcggcgaagtgataacgtgactgttgtcatggatctgtggtttgttgtaatgatttccctgctgtaccagggttagtttgccagtttttgcatgttacaaacatcgctgagcgggaataactggccaaaaaaataatcagaagcaaaaaagaggagggagggcagggacacgccttttaagaaattttctgaagagcggaaggaggcaggaggctggagcgccttctactttccaggtgctccagcgggccggccctggggactgaggctttggagctaattatctattgtgcccctggcagtgggccatgctgcacagacaggggacctgcctgggcacagtggggacggtccgtttttccttccaacttggctttctgggttagacatcaaaccaaccgctggcatttggtctctgccaggttctaggcgcccacgaggtcccctcgaggaacatcttttcagtaagtacctgcccgtgcccacgcatgtgtctttctccatgtggccgcaattgtgcgcgtgtgtgcacggcctgtgtcctgtcctctgagacgtggtctccaggggctacccacccctcttctgggagttgtactagccagcatccccctgggaaaaggtcccactttcctggtcacggccttgctcttggaaccttggctgattgtgtcttcttcctttctcatcctttctaggaacaaacaattgtgagtattcttctctgcctgttaggtttggggggctcttagttgctttggggttaactaaattccaggtgggggtgggctgctgctgacccaggagccctggatgagcagccctgtctgggacggggctgccccaagttggcaccttgtgacggggcagcctgtggggtcagcgccagtgggaagaagggaattggcttgagcccatgggggccgagctgggggcatgtgggatccccgaaggcccaccttcaccctctgcctcccacagcctccgtccgctaagtatggcgggcggcacacggtgaccatgatcccaggggatggcatcgggccagagctcatgctgcatgtcaagtccgtcttcaggtatggagctcctgggtccccgccttgtcctcagccagggggccctgaggactttgtgccaagaggggcattgcgcccagaagcactcggtgaggccatggcaagacgacctgtaagcccaggccttgcgtcccatggcctgtgatcccgccagactggcctgggctcggggaaggtggcaccagtcctgccacagtgtgcattgtggagttcaagcgtgtccccatcagtcagtgaaggtgggcccagtcccttctcagtcagagccaggtcagggcaggtagcaacaggagagaggtagcctgggcaggcttcctggaggaggtgcgggggggtctgggccagcctccctgaccctgccgtgcctcaggcacgcatgtgtaccagtggactttgaagaggtgcacgtgagttccaatgctgatgaagaggacattcgcaatgccatcatggccatccgccggaaccgcgtggccctgaagggtgagctccagggccaggggccaggatggggccctaggtgtgatttctttcttgctttcttccttcgtttcttgcttacttgctcgcttgcttgctttcttgcttgctttcctgctttcttgcttgcttgcttttttgctttcttgctttctttcttgcgttctttctgagatggggtctcgctctgtcgcccaggctagagtgcagcggtgtgatctcggctcagtgcaacctctgccttccagtttcaagcgattctcctgcctcagcctcccgagtagctgagattacaggcgcccgccaccacgcccagctgatttttgtattttcagtagagagtgggtttcaccatgttggccaggctggtcttgaactcctgacctcgtgatctgcccgcctcagcctctcaaagtgttgggattacaggcgtgagccgtcgtgcccagcccctgtgatttcttttacctccctctgagctgactcttgtggggccccacggctctgatttcagggcttgtctggctagagaggaccctcgtgcttggagactgggtggacgcctcctcgggcctgtttgcgctgcgatgctgggattcgagtgagagcagctgtgtgtgagcctgtccagtgacgggctccctgatgggttccctcccacccctccttccctcctgagacagtcctctctgctggggtcagctttgaccctcagcatctttcttcacaaaccaggtatcacagagatgcagttccgaccctctgcctggctcctcggctgcagccagcctggaggtggatggcacagcccaggcagggattcttggggcttcacttgaggtccttaaactacttccattgctcattttgcacactcagcccattacttgcactgtgtgaggagcgtgtgagcaaagatgaacccagggggagccccaggccctggcagtcaagtagaggggcctttgtgccagccacaggggacccccgcgctgtgagtggagcagtctgggtggggtaccgctcaccagcaggcggcctctgcttggcgccctctgactgctgtctccagcggccactggcctctgcttcccttcctccaggtgtcctgggtcgtagggtagggtccggccaatccgtggccttctccaggcagcccccgcctgcctctgagtgtggtgccttgatgcgggggcttggcagtaacaccgccaaggccaccttgctagctccagcctggccggccaacctgttagtaaagagtggtcactttctgttgctccagagcctggatggagaatggcatggctgcctggctggttgccagcctttattcatttattgacttgttcattccgtcgttcaggggttattcatggagcacctgctgcaccaggtgcccttcgagatccctgagcgtgtagcctcgtggggcttaggctggaagttgcattctagcattctagtgttcaggaaacatttttgctccccaagtcttctgaccccggcagccttcagctgccctgctgaggtggggcggggatgggcagtgccactaagcctgtgttgtgttttgtaggcaacatcgaaaccaaccataacctgccaccgtcgcacaaatctcgaaacaacatccttcggtgagatccgggtgtgcgggctgggggcttggtggggctaaggtggggtgagccagtggagtctggctccagtcagccacctgtcaggcctagcagcctctttctccgtcccctcccagcaccagcctggacctctatgccaacgtcatccactgtaagagccttccaggcgtggtgacccggcacaaggacatagacatcctcattgtccgggagaacacagagggcgagtacagcagcctggagcatgaggtgtgcatggggggcccgagatgagcccccccagcgtcaagattaaggggagagcttaaggaaccagggacaggtgtacccttagagggcaggggctgtgcccgagggagaagccagaaataggcagacagggttgcttcccacggtggcccggtcgcgccagcttgtttggccagtgctgctcttcagtagcacatgggtctcttctccccatgccctcctcagagtgtggcgggagtggtggagagcctgaagatcatcaccaaggccaagtccctgcgcattgccgagtatgccttcaagctggcgcaggagagcgggcgcaagaaagtgacggccgtgcacaaggccaacatcatgtatgtcccctgacctctctgcgagcagtccagaagcagctgcagtggcctgcttgggcctgctctgagggatttgtggtccaaaagcccagctacccaccgaggtgccaccctaggcgagtgccctgttgccctcgaggccttgccagaacccacacttaggggaggtggggtgggattctgtccattttgctggtgagggacaggttagaattcagaccccagcctcctggggccctctgcacgccccgtccctctggctgactgttgcgatggccaagctggtgtcctattcctaaccccccaccaggaaactgggcgatgggcttttcctccagtgctgcagggaggtggcagcccgctaccctcagatcaccttcgagaacatgattgtggataacaccaccatgcaggtattagcctgcccagtgctgtccccctgccctgagtgccctgggcttctctcacccatgcttccgaatctgctcctcagccagccccctccttgtcccgcagctggtgtcccggccccagcagtttgatgtcatggtgatgcccaatctctatggcaacatcgtcaacaatgtctgcgcgggactggtcgggggcccaggccttgtggctggggccaactatggccatgtgtacgcggtgtttgaaacagtgagtgccggtggcagtgccgcggcttgccgcctttctcctgttcacagacttagtgaggcacactcatcccatccggttagcccgttcaaaatgcatgatttagtagttttttggatatccagggttgtactgccgtcaccaccaggtcattccagaacattttcaccaccccacgaggaaagcctgtccccataagctatctgtccccacaccttcccccaacccctggcacccgctggtgggcttttgtccctgtggagtggcttcttctggacgtgtcacaggagcagagtcactgcccggcatccttctgccctccacccactctccttcgtcttgcctccccaggctacgaggaacaccggcaagagtatcgccaataagaacatcgccaaccccacggccaccctgctggccagctgcatgatgctggaccacctcaagtgagtggctcccagtgccccgcaagcccctggccagccctccgggccccagggactgaaggctggctgtcccatcctctaggctgcactcctatgccacctccatccgtaaggctgtcctggcatccatggacaatgagaatgtgaggttcccctcgcaccctaccctgctgccccgcccagtctccccctgcagcctcctgtagcccgcctcatgcactgaccacagcccccaggggaggatggtactggatctggccccatcttctggcccttagctggtgccacttccctcctgtggcaatcccagtcctgcacgtcacaggagacagcggggggtggcagggcctggtgtgtgccgagcctgcctgtgtcctacagatgcacactccggacatcgggggccagggcacaacatctgaagccatccaggacgtcatccgccacatccgcgtcatcaacggccgggccgtggaggcctaggctggccctaggaccttcttggtttgctccttggattccccttcccactccagcaccccagccagcctggtacgcagatcccagaataaagcaccttctccctagacttggcgtgggcctccctcactccaggcaccgatgttcagtccacactttattaagaaaggaatacacacactttctccgagagccctcacgggggtctcaggcagaacacgctctgagagccgggcctggctccagcgtctctctgccctgtggttgtggagaactggcgcccagcagggtggtgggagctgtcccgcttttcccttaaggcacggagagctggaggtggagccacagccgggcctaggggttgagccaggggtgctggaggcagtcagcggcactggcccgcttttcggggatgtactccatcatgggcagcagaaaggcgctgaactgtgtggcctgctctaggggccactcgtacttttccatgagtacctcgtacaggccccagtgcttgagattgtggatgtgccgcagctctcctgcgggcaggccagcgggcgtcaggctctgtccctgtctctggacctgccttctgcttaggccctggctcctgggacccagtgttccctctgttgcagaatccaaggtccccgtcccaccctccctgcagccacatggcctgaggctgcccgggccctcacctctccggttgaagaactcccgggaatagcggcctgagagggcgaaggctggggggatgtcccccagaagctccactatgtgagcgatgtggtctgtgggcagaaagaggaggttgggggcaggcaggccgggaggccgggaggctgagcccagagccctcaccccttaccctcatcacgactgtagtcttctccagaatgcggctcgaacaggtagtcaccagtggccagctcgaaggcctggaagggggaggaggtgaggctgctggctggtgggctgctggccctgggcacagggcagcccgggcgggcgtaccatgcaggctgtgctccagatgtctgccggggggccgtattcggcgccgatcagcacctcgacggcccggtactgccgagtctggatgtcttccgtgaagtgcttgtgctggaagcaaggggagccctggggacgggctggggccaaggctgtcctgcccccacggactcctgccccaccccgatccgcctacccgaggagctcagtggggtttgctgtgagcctcggggtccccaggtcctccaagagggacaggcccagtgatgtgaggctgaggctgatcccttcctagtggcccctgcccttggccatggccccagtgctgttgactgggcaggaccagtgcccacccagccgacggttcacgtgcactgcagactggggtagggctccccaagagcggccctgtgcctccacccttggagcagggccccccactctgctctcccacacttgctcataccacccagcaggcgttgcccaggtctgcgatcttgatcttgatcttatctgcattttggggctccagggggttcaccaggaggttcgaggcaccgaatggtgctggggaaggcagagcagggagactgaagtggtccgactactgccagccctgcctgcccaccacttgccacccaacttactgctaggcgacaggaggcccccggtctctcgctgattggacgagccggagaggatggagcaggaggcaggagagaagagggagccggagaagcctgaggtctgtgagcccgcgctgaggctacggccgccccctggggcgggggaggaagaggctggggagggacctgctctggcgcccccggggtgacagcctgaagaggatgtggagccgctgcccccgtctagtctcaagccagagtctggggagacggggtggaggcagctgctgagcagatgtcttgcagcctttgctgcgctccacggcccatcaccctctgtggcccctcaccctcagcctgggtggcagcctccatggcctccagcctctgcaggtcccgcagccgctcctccagcagccgcttctgctgtttccgtttgcgcctcatcttcttcctcttgtttttggacagcttaccggtctgctgtcagagccagggtcaccccagggttcctgtcgcccgccccagtcagcatgaagtggaggtttccctgcacagccgccagggaagaggcctctccgggccccagggctcccatggacaccagaatgtggcgccagcgccccttggcaccagctactcactactctccctgcctccccgcctgtggccccactccccacagctccattaggagtgggaagacctggccggcccgcctcagggtgctctctgtcccctctcagcccaagctaaggcaggcggaagtggccattcggggaagacagcatcctttcaccaagagcagtttggggcacttgaccccccccgggaattaccgtcagcccagccacccagcctttcgggattaccaccgtgggagtgcgtgaaggtggggggtggagccactgtggctccagagatggcctccagttggctcagatgggagaggaggcatgggagagaggggccccccaacttaccaagacctcctggggggcagtgctgactgggagtgcaggtggggagcggtggggggggacagggaggaacagagactcaggcaggggttcaggcccagaggccccgacccagccccatgtgggcccttggtacctatggagcgggaggggggcggcgcccctgcctgttgccactccgtggcctcggcagccaggcgcctgatgtaagcgtcccccacacacagcaagatgttctcgggcttgatgtccgtgtggatgatcttgcacttggtgtggaggtagtccaggccgtgcagcacctgcagagagtcgcacctgacctcctccaactcccgcccaggccaggctgggcagcccagtgggtggcactcacctgcctcacgatgctcttcacgcagggcacgggcaggccctggtagttggacttgatgatccatttgaggagctggtggcccagcacctccagcaccatgcacacatctgggctgggagtgaagggcggccagtggacaccagctgcggcacaggccccacccaccctcagctaggggagcagcaaggcttgggccgtgtggaggtggggaggcagggcctcccctgggcagtcctggtcaccattatgctggtgtcatcatcgatagtgtccctgtcagtctcaacaggtatgccagttgggatggtgcattttgtggtcatcctagaggtggcgctggaggagcaggcacagaggcctctcgggccagcccactcccatgctagttatgccatagggcctcttggcagtcccccaaagggaaggcagtgccacagagacagcacctgccgtttggggataatagcaacgtccatggacaatcaacgctagcttgttactgcctccacgtaaacacagttacctgggggcggggtcgtgccagaggctcccgttactgggagggatgcaagcccattgtgcgggtctgcagacaggctctagcagcgagggcccccccatttgccggcccttggctgccacactgctttgctcttcctgcaaaggatacggactccattgactcctgagatcctgaagtcatcaatgagctggacaatggtctctcttttggggtcactggggtcgctgtcccggacctggagcaaaagccaaggggccacagatggttccaccctgccctgaagcccacagctcccttcagtgtacccttctcctgctccagctgggccctgctggaagaaaggccgccaacccctcctgtccctcgcctgttcctccagatcctcccccttgggcacagccagctggaggctgcccctcagggagccccgccctgccccacagagccccggcaggccttgcacccgcattgccaggccccaggcagctccaggggagctgggagtggggtagggaggtgcctcacacatttcaggagcttgatctcatccacagctgtctccgtgtaatgccccgcactcttcaccactttgagggccacaaagcgcttgcgcctgcaataccgagacccttgtaggctgtggccctggcaggacccacggcggggatcagggtggccccaagcaagcccagggacaggatcccagccagtgctgggccccggaggcgaaggaggcactcactggatgtcccagcagagccagacggtggagaagtggccccagcccagtttgcgcaccacgtggtaccgcccattgaacacgtcgccgatcttcacagggtggtagccgcctgcccaggggagatgtagattggggtggagggggttctcactcccctgggcccccgaacacctcggccccattgaccatctggcccatgtgggcccaggactgccctgggtccctgcagtggccgtgaggccgcatgtccccaaggccaagtctcacccttgcagtagtctttggggtcttcctgttcctcgtcgtcggagcccagaaggccctgcagcatctgaggcaccggtgtggccagggctagttcggagcccgaggactcgggcccgcaggaggcctgtgagctgcgggtggggtgagtggcagtgggcatgagagacgccaggggctccgggtgccccagccgagccctacctgctgctactgccgccgctgccgccgctgtccccaccaccgcccgtgctggcgctcatcccggccacgcagcccgcagctccggtgccccgggcggctgctcctgtggggcccggccgcggcctgcgaatttatagccttggccggccgctgatctcacccgcctttataaatagcctcccagctgctcggctgtgggcaaggtatgcggtgcggggagggggcggcgcgacggcggccccagagagcccggcccccgggcagaggcccccctcctgctccaggcccaccctggaggcagagggggctgctgcttggggaccaggggcaactgggcccccaggctgagcctccgcaccccagctgagggggaggtccacgcgggggtgaagcagcccgtaccccaggtcgggctcccgttctccggtgcggactgtggggatgtgctccacttggcaacctggtccttaggccaagcccccaccacctgtgcccctgtgggcatcctcctggaggtgcccttctcattcccatgggaaccctgtccctggctgctcccagccacttcctgcttcttctatgtttcatcagcccctaggacaactgggagtccagtgccctctgaatgtggcgtcactggggacccctcatttcccctaccagaggcaacaggcctgctgaggggaggcctgggagcttgccagcccagaacctgctcctgcgacgctgcctggcgctctggctcccagcgcctgctcttcctctccaccatttgcaaggtgcctgtcgtgggctgctccatagccagacatgagggaggcagcaggaagctgctcactgctggggacaagcaagcccatagccacttccccatgagtgcggtggtgactgaggggcctgtgacccaggggctgcatcatgagagaccaggagaaattgggtccccagaagcatccagggcagcacagggcacagtggggcaaggcctgcggccaagacgcgttccagcccttcacgtgctggccacggctgccgcatggttcgagggcgaggactagaggcctggtgtctgtaggcttaatgtggagcttgggtgatatggggttggggggtggtcactgagcttctgctcagcaaaagatcactctggccacttcaaggacaagggaatggagaggcgagggtggagccgggaggccagctggggcctgacagaggagtcccaatgaaagggagggggctcggcagagagggtgtttgtcccaagatattggtgcagtgtccctgtaccagggtccgtgaactggtaggggtgggccaggcattgctggaggggccagcgaggtcagagagtgggagggaaagtgaagcccgggtacctgatggcctctctttgtctgtgggtagcaggttataggcatggggctgagggactctcagtcaggagagcactgagtcagctcctgcagggaacagcaggggctggggattgggccctttgtcaaaagacatttctggccaggcgcggtggctcatgcctgtgatcccagcactttgggaggctgaggcgggcagatcacctgaagtcaggagttttgagaccagcctgtccgacatggggaaaccctgtctttactaaaaataccaaaattagtcgggtgtggtggcacacgcctgtagtcccagctactcgggaggctgaggcaggagaattgcttgaactccgggaaaaagaggttgcagtgagccgagattgcgccactgcactccagcctgggagagagagcgagactccgtctcaaaataaaataaaaagacatatttctattttatttccggatgtgattttccagcaggcaaataaatacaatggggagagggggaaggagggggatccttataaattagaaacaatctcaggtggggggaaggtgggtgggctggcaggggaggtggcaggcagggagcccactgctgggcacagtgcctggctttgcaccctgtgcccccaggctctgccagctcccctcagtggctggctcggttccggggtcataaggcgctgcggtgttggtggatccggcttgctgctgtctgagccagagctcacaggtcagtcactttgttttccaccagggcggcgacctgctgcaggcggcaggccagctgcagcttctggcccacagggtcctcctccagggcactgataatctgcccgggcagaggagggtgcctgtctgagcctgcccctctgcctgctggcccagggccacccaccctgcttccatcaccgcaggagcctggggatccagcaggggctgcctggcgtctccctggggaatcagaatgaaagccgagtcccttccccagcctgggccccgccagcatgggctggcacccctgctcccccgggagggtccacgggcctcccgctccactgtgcctcccctccggagtgccctgggcctcacctgatcatagtacctgtggatgtggttgtagagttcttgcagagcctccagacagtggggagcagaagtgtagttctgggggcaccacgtggaggggggcagtgaggtcccagcctggtcctcaagccccaagtctcccccctctgctctgctagtctttccacccacgtgtggacaggcgcaccccccgggccatgcctcaccccggagagctcagccaaagcagagttcatctcctggtagctcgccggagagctctggcgaatgtccgcatagtacctggaggagcagacttcgttaggggtggggcagcccccttccccgcagccccgatgcctctgacacccacctctccaccatctgcttgtagcgtgggatctcccgggcgtagagcagtttgttcactggggaatcctgctccggagggaggggaggcgctaggcatgagctcggaggtgaaggtgcccccatgatgctgccactgcccacccagagctctgtgcacagccctctaggcttcccccataagcctttcctcctcaagcccctgccagctgctgctgctggcactgctctcacccggcccactttatgctccgaggtggtacaggagtcaatgaaggtctgggcgatgacagcaaggatggcgtccacattgtccgacacccgtacatcaaagatgagctgtgggttcttcaaggcattcacccagaaccgcagcagcagactgggggcgcagggcaggcgtgggcgtgaggccctggcctgccatcgtgatctccgccccatgtactccagcctactggcaacacactcggagccaggggccgctggaagctggcctggtggcctaggtgacctgggccctagatcttcctgtaagttccagaaaccccaggtgggcgcatccaccctgggaatgtcctggtctctctgggactcagtggaccatatgcacagcaggggtggggcagcaggaaaggcacctgttggtcttccagatgtgcagggtccctgggtcctcgatgccgtgcttctctgctagctcatccagaaggtcaaacaggtacttgacggcgatggggatgggccggttcacgctgagaatggcctggaaggtgtcgtccacaaacttctgcagcgtgccctgcgaggcaggggataagggctgtgtggagggcagggtgtgggggccatccacggctgaggctgcccctgcccctcccacaccctggctcggtcggggtccctggctgagcctcctctcaggcccagccacccaggccgcaccaaccttcatggacagcagacgggtgaggtagatttccggaatggccttggcccttgctggctcgcgctcccgcaggctgctgcaccgcaccttggccccttctggctcctcggtggctttcaccaggtgccagaggcacacccccccctcctcgccatcctccagcgtgggtatgtctgagggcacaggagcctggcttcagggctataccccctgcccctggcctgggatgcccagtccactcccccgacaaggtggggcagtgtggggactggaagaaaggaaggagatgggcagaagatctcggtggggtgggggatgaagttgaggcagatgcatggccaggagttctgcctgcccagcctggactccagtggccccaggtcagggccgagggactcactctctcccaaggggcacctctgggccaggctctgggagatggtgctgccacggtgcagctgagggacgagccccactgttgctccatctgggacctggcagagatggggagcggaggctgtgctgacccctagccaggcgcctacaccgcccacatcctgccctgcctcgcccttccccgccccagacccgccctgccctgcctcgcctcaccctgccccaccccatccctgcccttccctgccttgcctcgccccgccccgccccccatccccgccccagccccgccctgcctcgccccgccccatcctcgccctgccgtgcctcgccccgccccagccctgccctgctctgcctcgcccctccccaccccagccccgccctgccccgcctcgccccagccccgccctgcctcgccccgccccagccccgccctgcctcgccccgccccagccccgccctgccctgcctcgccctgccccgccccagccccgccctgcctcgccccgtccctgctcacaccttgtagtgttgcaaggtgttgagtctcttccagtggttttgggtcacggaggtcaagtcttcgtccgatagggtcaggtgaccagccaggcctgagcgccactctggagggagtcagggaagcagatagtctacagcctgctctccacgccccacactcatagtaagacacagttgaggggctccaggtgccggaggggtagggaagggtccctggggtgggtgggcagggctggctctctcaccaaggtctagggcatgcactgagggcctctgggagaagggggtgcccttgtagacttggtccaacaccttctccttgacctgggtgatggtgtccgtgtcgagcacccgggctggcacgcgctgcatctcgctgctgcctgcggccccgccagccccgggccccaccagcaccatcagcgtcaggggctggaactccacgtcctcccgcagcaagcggctatcattcagggtccgtttggccttgcctgtcacggcgtccacggggcctttgtccacctggtactggatggcccggaagagcatgtacagtggttcaccagccacctcctgcactgccaagatgagccggcatcagccaagcgagggaggattgatgatagcccttctcgcctctgcctcgtctccagccccggagagggttcaaagtccttccctttccaaagccccccttgccgggccttcgtcacgtagggcgcaggcagtagccccctcatggcaagaggggaggagtctgccactcagggctgggagcaggcgggacagtgcccctcaccctcaggaaggcgtacaggcagatggacagccagttggtgagcagtttctccaccatggtctctgtcctgcggggagccggccacagggtcaggcctttgtgcctgtgtccctgctgaggacatctcactttccttccccccacctgctggggcttcctggccccacccgcccctggacagagcccgcccagggtgcgatgggggcaggtctgtggcaagccctcacccccgccaccgggtccaggtcaaggccaacctgcgtagcatgagcttggggttcctgtgcacgtaatgggccgccaggtcacccagcagggtcctcatgatgtccgtcaggtactccagcttgccgtgtagcgctagcgacagcagcgaagccacatggcagcgatccctctgggaaaagctgggctgctcctccagggtgtggatgagctgagcaggggtcggaggctcatcctgggaagccccactcctcccccacctttgtctcaggccagtagttccccagccccacctccttgcccactgggcactcccgccacacggccctcaccgtgaggaggaagagcttgctgttgagcaggttggagagctgcgtgaggccctggcgcacagtggcacagtggccgtcctcccctggcccctcaggcttgggctgcagcgggcaaccgccatggccagggaagaaggcgcgctcggcgtaggtgcggtagtccaggaaggggatcccgctgccctccaggtcgctgctgaggtcggtcatctccgtcatgaggtctgcggggccaggaggcgccgaggtgtgagttcaggcctcgtgggtaccctgtccccccgcctccgcacccacctgtgaactccttgcggcactggtctcccacgccggtctccaggctctccagctgcactagcaccttctggtagtcccgcagggcctgcttgctcttgtgcctgcagcccggggccagcttcatcagccagggccggggccagcatcagccagggccggggccaggccagccgcctgccagggcgcccttgccaatggcgaggagggaagtgtgctgggggtgggcgggtctcacctgtacatgagggtgaggaggagcacggcggcaatcagcactgcagcacccatgcccacgcctgcctgggcctccacgggaaaggcagacagcgggggttcagcctcgtactgcacagggcccagggccagctgcacattgcccatctgcacctggggggcgggcagggttcctgagtgcatgctggcggcacccggtccacctgcccacccagggcacggactcaccacgaactgtggcaggccggagccattggcaggctgcggggcgtgcgcaggcggctcgcagtacaggtgggtgcgcgtgagcgtcttcaccaggcactcgccgcggccgatgtgcacgcgcacctcctccttgctgatgcccaggttgaggccctcgccctgggacacacatgggagcctaagctgctggcccccacagaggcggcctgagcaccgtggcggggcagggttgaaggtggccctcacctccacatccaggacatggcctggcttgaggcggtaggggcgggcaggcccctcgcggctgaggggtgccaggcgggggttgggctggtacaggaagccctggcccccactggcactggcgaagtccacttgcacgttgtctagggtgaagaagacccgctgcgggtgggctctgtctggtacagcagggctccggcacaggaggaggctggacgagttgacggagcagacggtggagcactgtggggcattcagggccgaccacaggtggagtgagctgggctctgctgtgcgctgctaggggcatggcggcctaccctcctcctccccactgggcatgggcatggtcggggacagccttgtcgcctgctggtgaggggctcacctgcagcagccccccaccgagctggatacaagcctgggggtccgcagcaggggctccacagctcctccttggctgtgggtcctggggctgggccctggaagcctgcacctctgcgtcagcctccagccacacagacagtaggggccgctgcaccacgtctaggccggtgcccctgacacggatcagtcgcccacccctgtaccaggatggcagtcgggtgtgggcgggcggtgggcaacatagcccagcccgcatcccaccttccctcctgcgtggtgcacaggctggcctgcgggctgaccctcacccccggaagctggcactgggctccgccgctacaagctgggggttggcggtgtagcggaaggggctggcgagcagtgtgcgctgggcatggccaaagaccacaaggaccgctgcttctcctggggcagcctggggcctggtacggcacacgatggcctccggacacactggctccaggctgcaggatgggtagtggggtctctcatctcggctctaccacccctctaccccagccctggcccaacccccgtaggagaagccctgctttgcctgccttgacaagggcagggaccactgggggtggccacagcaaccacttctctaaatgtaccacccccactgaggcgtatgggagtgcccaccacccgacggcagccaggccgggactcacatgggacagggttggccacccacgaaggcactggtgttgccacctgtctggaggtgctgacctcggatggtgagctgggtgccccctgcctgggggccccagcgaggactcaggctcagcaggacagggtcctggcgaacagcgcaggctgggtaggcacggcagcccagcctggccctttcacccccctgggccatgcccaaggccctccggttctgaagcgcaggtcatctctggacttcacctcctggggccaaagtggaccacgccctccttcccgaggccactgcacactggccagcttcctcccacccacccctgccgcatggggagtagaagtggggctctttcatcctcactgccactctgtcccccttgggacagcctcctccccaccacagcttacagcccccagacctggagctctaaactctcaaatccagttgcctctttgggcagaacccacccctgccctcactgctcctgtcccaggcttcccacccaggaaacggtgccaccaagtgcccagggcaacagatcctgagagcttcgtgcctcagactggcctggctgcccacctccactcacatgccatggcttccctcctagacatgcagcggtgcttcctgctccccgcagacccagcttgacatccttactaggcgcctgtccttcctggccctccctcctaccctcccctgcgtagggcacacctgggaggccactgacctggtaggtgaagtgctggcttgagatgcctggtggctggctcttaatggccacccggacgggcccagtggtgccattgggggcaggagatgtcacacacacaatcctggaaagccgaggcctgggagctgctcagggctcagggacggaggggacagcccacccctcccctgacccgagtgccccaggtttcttggccacaggccttccttatctctgggtggccatctctgagggcctccccacccatcttcaccctccaagtgcctcaccgggccgacgtgcggtagagagagggctcagggttgcagggccggctggccacgctcacggcgtactgcacatcggcgaaggcccggcccaggttggagcccaggatggtgagggccaagcctccctcagggggaccggtcaggggctcgacctgcagcaggcaaatgatggcagatggggtcccccgcacccacgctccactctgcagtgctgggtgcccggccagccaaccagcccagccaggccgagctgctggggtttgggggcctggggcagggctggtctgatcacggaggacaggacagtgcggggcaggagaagtgggccactgggctgtgggggcccggcaggagactcactgcatcaatgctgggcgcaggacacagcagctccacagcccccggcgggcacaagggcccatagcgacaggcaggctggccgtcagcacaccacaggcagcccaggctcctgttggccgcttggcagtggctgcagtccgggtggcccatggcgcagtcgtacaggatcactagggagggtcaggcagtgtgctgagcgcctcctgtctgccacccaccctgccccgcctgcctggctgccctcaggctcaccataaagagcatgggtgttgtccagcctctgggcttcaccctgggtgacgtagatgggcactgggagctcccgctgggacatggagggataaaactgtgggcagagtgtggggtcaggctgggtgcccactcagggcacctctgactcttgtctcctctgggccaccccccagaatgaatgtgattgttccctgcctctcccccaagactggggcccacagacagaggttatgggccccaagcaggctctccacaaagatggcagacccctgagggtctacggaagcttgggggcaagagggtttggaaggcagccactcacctggtgggcctggcagtggatgaggcctgaatcccctgctgtctcctccagggtggccggcagtccccgaagttctccaggcagctccagccagcagtggaaggaggcaggcaggccctggggaaggacgctgtcaggagtgtggacacgctgttggcagacctcactgccctgtccccttccctcctgatggctcactcggaaatgttgaaggttccgcacgcgtagggccaaatggctctcccagcccacaggcaccaggtggggacctgccaggccttcgacctgtgggcaagcccctgggccacgcacctggatgtccacctgggaaaacaagagccctcagcccttcagaactcaaagggcctactgctgggcgggtctgggaagggtggagaagggacagccctgtctctgcccgaagttcgggcccacccacctcctgggcgctgtagatggtcctctcgccctctgggcagtgctctccgtacacgcagtggctactctgcgggcaccagtgacaccgccagatgctgcccacgcaagcgcgacacctagaggggcagggtggctgctcaactgagtgccctctggggtcgccacccctaccccaggaggcaggcccagggactcacggggcagccgcctccaaggcctggacggcactgcagtcataaaaggagaagttggtggcagccacagtcacgtcctcgaacatcagggccaggggcacagtgacgtggtctgggaggggacagtgggggcaggacaggtcaggtggctcattacccctccagcctccatcccagccccctaccccatgggccactcacctgtgcctggagggttaagtggcacctggtcttggggaggggtgacacaggccacgtggggcccttccacatgagccaagctgtcatagtccccgaacgcacaatggaagtattcatctgcatccaggatgggcagccgggggacagacaaagtgacctgggatgcagcggggagaaaccgggagatgtagccagagagagggggcagcagaggccatgggagaggaaggaggacgggaggcaggcggggttcatgctccaggcagtggtcatgctgcccagagggcccagtggtggtgggcggcttacctggccctgctcctggcgggggtggtggcccggcagcaggctctggatgtgcaggcagtggctgtcctcctcataactccacagccactggttcagctggcctgcccgcccgcactggcccttccgggtacacctgccaggcaggggtccatcaggtcaccgtgggggtcctagactccaaggatgaccggcaacaggggcctggggaggccggcccagctggagtgcagtggggtgcaatgagcaggaggcgtgaaggggactgtgtccagagagaaaggggccaagcaggcagggcctcatggccaaggcgtgggctccagccctgagaggcaggtgcggctgggctgagggacgcacagtgactcagggctgccttaaaggattccaggggctgccgtgtggagcaccggctggaggacagctgtgtggggttctggaccctggctggggctgctgggatgaggagtccacaggccgggtggtgtcggaaaaggggggtgccaaccagattgacggctcagtgagatggggcaggatgggtgacctccgtggtggccctgagtctctccaacaggcagggttggcctcccggcacgcctagggctacttccaggggcagcctcgtggcacacaccacccgttggccctagcctaggcacaggccccgtgctcacctgccctggaggacacaccagccacacagcgggtcctgggcctggaggcagctggcacagtcagggaactgggggcaggctgccacaggtatccggtccacctggaggggcagcagagcagagaggcaatgggcacgagacttgggccgcgtgtgctggccccttcagccccaggatggccctcacctggtgggcagtcaggacatagaggtgactgccactgctgtccagcagcaggtctgggctgatggctgagcctggaggccccacttgctgggagtggtaaacctggccctgggagccgtggagaaagacctgagtggggggacaaggacgaggctgggccagatggccaaaggttgcctgttccagggacacgccctcctcctagtgggggctcctttttagagccagttccccttcctgccgggccatcgagggaggacacatcacttcccccactcagcaccctcaggcctaggacactctccagggaaccatgacaccggggcagcagcggcaccctgggtgaggccccgtgtaccagggacagttctgccaggtgggagggcagctatggggagacaggaaggtcaccaggaggcaccacaccctgcccacctcacccagccaccccagccaccttcaccgtgagccaccaccagctggtgaaggccgggctgcagggggcagtgctcagccagcagtcactgtgtggcaaagtcccctgacccaaccgtgggatgcgggctaagaggtggaagttgctgggggctttcctgagcctccgtggccaggggcacacccagccggacagcaaggccgggccctcaccttgtacagctggccctgggtgtcccccaggaaggctatcatgtgcccatctgcctggagagctgccacggcgctgaccggctgcccgagcttcagcagaggctggacctccaggggctggcggccagcaatggggctgggggtgtgctcgtcgccacaggggtacgactcgggggaatcctacgtggcaggaagtggagaatcagcccccggaagagagcagagaggcagtcagggggggtacccaggctgccagcgggaggagagccaggcaccctgggatgaccccaaggcccagcaatcagggccgaagggccagggcacctggcaagctcatagcatccagagggagaaaggtggaaagaaatgggtggagagcaggcaggagacctggagactcagctgacccctggctgagaggttggctggcacttcccatgggcaggcacccctgtccagtgctgaaagatgccagccatccacagagaggggggatggaagggcatgccactcacaaggggcagggtgacgcagcgcgacgtgacgccgtactccacggtggcttcctctgcgccgctggggccccggccgcccgccgtgtagcagagtctccgggcctgctccatgctggcacccagctccaccatggggaaggcacagagcgccgcctgggtgccccttgggcccgcggcaaacacccctagcaaggtgcccggggcaaggaaggcggcctggatgaggccctggccctggcaggcgagggggacctccacgtaggagtacaggttggtgtcccccaggcagacgcgggccacgtaggagcggtactcagcctgggcccgggccccgcggcggcggaacacgaagtaggcggagcgggcgtcggcaaaggccccgacgtagctgttgttgtagtcggagaagtcgcccaccaccaggcggcccaggccctcgctggagaagggctgagacccggccagctggcggatggccaggggtggcacccctgccgacagcttgcccgccaggcctctggccacaagcaggaggtcccggccgggcaagggcaccaccagccccaccgttgccactcccggggtattggcagccacaaactgcccgtcaccagggtcctcagcctggtacagcacctcggccacatccccaaggcgccgtgtctcacacacgccctgccgcacctgcccgcaggccaccagctcctgggcgcggctgctcaccagcagcagctggttggcattgtcagtgagctgggcctgtgggcactcggctgggtcacggaagggcacgcagtcagggctgtcgattacagggccagtgacagccacggcctcgagctgcagctcggggctgagctggaagaggcggttcactgcgccgacatagagtgtgcctcggccaggtgccagtgccaagtggttgagagtggtattaggtgcggagaagcgatgggcccctgtcaagggcagtggcggtggggacagcagcagcaggaggaggcagaggccgaagggaggccagcgagccatcacgggggcctgtgagagggcacaggtcagggcagtgggagcgcaaggcagatagaggaccagaggaaggtggaaggtggggtggacagaggccagggtgctcagggccagggagggagggaggcagagagatggagaatgagagagagtgagcggagacaaggagacagagggggcacagagagagggggacataaggagggacaaagacagtgtccaagagctggagcaagaggcagggaggggtgcatgcacgcacgcacaagcacacaaggacagaattctttcatctcctactttatatgcatgtagattgttgaaggggggcaggtcctggaaagccgcaagagcgctaacagagggactgtgagtcacagagggggcagggatggagagagggcaggggagggagggaggccgcgggagctggaaggctggcggaagctgtgtcacagcgcgcccctgcgcccaccacccagacaagagagatctaagtcaggtgagaggagtgaggccaccgtgtgccccaagggaccagacagggagagaaaacctgccttgggcagccagggccggctgcaaggaggaaccctccgcagctgggggaaagagccaggcagccgcgggctgagcaaggagcaagtcagcgaagaggcaggggtgagctccatgctggcgcccagctccagggcgaggaagcactggggcaaggcagcgggggtgctgggagaagccaggggtgtcaagagacaacacaggcttcaggggtgcggggaggcctgctcctgccccatgggccccagcagtttgggtctctcagggcctggcacagggggcctcagtgtaggagtgtcccaggagaagagcagaccaggagagctggctgggggaggggtcagggaaggggcagggaggggtgccagactggagatggttcctgggtgtgcctggtgggaccccggggtgagcccccgagggtgagaggtgggagcagccccttctctggcccctcctgccctccacagagagatgctgccctgggtgtgtggtcacatgccgaccaggagtggggccgctgcgactcagggcagagcagcgcctggaggaaggcccaggagccgcttatctcaggaacacaggcaggaagagcacggacacttcctgcggaccccgggctatctggggcagtgtctgccatgagggaggctgcagcctgtatgtcctgggcctggccacagccatcctgccctaccctgcccctcccaggaacatttctggggacaccgggcctgggcacttaccatgaagtggtgcagcagaggggtctcctgggcggcgtggcacatacgctcagttcagctgccccagggcagtggcgatgggcatgagatggctgcgggggggcattgtcctgagtgggagggagacagtcgaggctcagccccattcgagctggcctggggaaggaggggcggcggtgggggtggcgcccagggcctagcgaccgggctccctcacagctggcagctttgtcaatagtggccaggccaaggcagccctgcctccaccacaacaatgttccctctgtccagaggccaggccagggccccactcgctagtgctgtcacccccactgggctgttctggacagggggctccttgccacttcccaccctcagggagccacccccgggatccggggacaaagggccggggtttcctccagccagccctccccctctggccctgcaacccctgtgtcactaagcatgcccctccctggctccccgggtccctgtgaagggcacggggtggaccttggagcccctgcaaatgccggctggtagccttggggcctgggtgaagtgccagtcctggccctcaatgcctgcctttgtccaaaagatcttcctccacacccccagcccagccctgcccctggggactggtgaagtggtgccaggtacagcatggtggcagcgagcaggaccacgggaggaggctgcttgagatgggctgaggcagagggtccacaggccggggctgtccaccccaccctctgaagcaccgtcctgctggcctagatgccatccatgcaggggatggggaagggaggggcacctagcagctagaccccctgtcaccctcacaggccaccctggccagtggcacaggagcaggtgcactggggatggggtctctgcctcccccacagcacggcagcagtaggctccagggcaaggtggcagtgggctgctgtcacctggctgggccagttgggtggctgtgggggtggggagccaggcgggcagcctctctaccctgtaccctgcccgaggctggcgttggctttcccatttcggggaagaaacatggttccccacctcctaaccccagggctaccacttgggggacaccgtgctcccagacacctagtgccgtcgtcaggctgggccgacacccgagcgctcttgcctgaccccagccagttggccctgagaccctgatgccttgccctgaggctggtagcccctgcaccccaagcccaagcccaagcctgccccagctcttgcctacctggtgggccaccggcgagggccaagtagcagctggcggtgccaggagcacgtctcacagagccccagcctccctccccacaatgcaatcgtgcccagtccgactcatcccaacaagcccggccaggcagcccagcctctctccgcccgcccctttgcccaatggcacagggcaggatgttgctgccctctgctggccgcagcgggcatgatggagtactgaccgtgggcacctggcaggtgagagacggcagcgccctcctattgggtgggcattccataacctggcacgaagcacctactggatgccaggcttgggcttggcactggcaccatccagaaacaaacacaggttgggaaactgaggcacaggaggttaggaaacttgaataaagtcacacagctagtatgtggcaaggctgagtcaatcacagggccccttcacttaaccgtcaggctacatgaccttgaaccatgaaccttggcaggcgttgggcaggagatggagctgaggcctaccccaggccaggcctggacgtgacatgcccacgtggcgttgaggaaaaaccagtgtttcccaccgactggaacacaaggttggtcaagggccgtctcccagggtgtggcggaggtcagcaaatcaggtggggtctttgtggccaggcttgagaacttgaacttgtctcgccatgggcaactgcaagctggtggcactggggcagagaatgtggggaggcctggtccagtggtggtcatgggcatggagagaggcgggcgcgttctagaggcgctctggggaggcagcattctgaagactgtgcgttggacccagggcaggaggcgaaggcaggagaatccaggcgaccctggggcttttctgctggggcactgttccccctgtggcagggccatccacagaggggctggcggaagtgggaggacggtaagactgaggggcccatgagggaggaggaaatggtgatggggctggggaggcctgggggtgagaagcttggctcaggtggctggagccctgggggcggccagggtatagggccaggtgttggccctggagctcaaaggcccagcagactcggggtatgggtgcttccctgagcagctgtgtcattctttccaacctgcatggagagaaatggggcacagaggtgggtaacttgcccagggccatgacctgacgtcgtttcttcagagtgcattccacagagatgggatttgaacctgggcattctggcacgggccacgctctggaccactgggccccagatccacagcttctcacctgcagccgctgaggatgtggaggcagaccaggcaggcccgtgggaaggaccaccaaaaagcgagtgagcagccggcgaggggtctctccccaacaggaaggccaggcagccttgaaggagccagggagggatttagaagctccaggaggggaggcttgggggagccagctggcctctctccctctccctgtccttccccccatgcctaccccaacacacacacacatgtccttgctggccccggatgagacagacgcctgcaatctggcatggggaatgggtttctccttcctttccacagaagaaaataaatcaggctgggcgtcgtggctcccgcctgtaatcccagcactttgggagcctaaggcagcaggatcacttgggcccaggagttctagaccagcatgggcaacatagtgagacccccatctctataaaaaaatttaaaaattagccaggcatggtggtgcgagcctgtagtcccagctacttgggaggctgaagtgggaggatcgcctgagcctgggagttggtgcctgcagtgagccgtgatggtgccattgcactctagcctgggtgacagtgcaagactctgtctttaaaaaaaaaagaaaagaaagaaagaaaaaagaaaataaatccatccacaggcagcaccattttcataaatatgtgtgtatatggcctgcatatgcaccttctacgctttctgagcagataagaggcgtggctatggcagcccctggtctgaagctggtgtaaccagaaaggatctaggctggtttggggaaccggaacatcttatgtcaggggagtcgtgctggatttatcctgcaatggccgggtcccctcaccaagggatgggaaggcagcgtcaactgatctggtgtcgtctccttgctgtgtgccaggcttctcaatgctggaaggggactcgttgggtcagtgggacgtgggcttcacgtttgctgggctgaagacgtagctctccatgctggcatcccagcggacacccccactgccactgctgcaccacgtcttcacgtacaccagagagcagacttgagagtttctgcgcatacagtgggtgtgaaatggtgccctgctgggttttgaatcggcattccttgaccaccggccatattgcagcacttttcatttcttctgtcaaatgcccgtgcatgtcttggcttacactttgcaggtgttctgtattttccacaccaatccctggggtgtatgtcttcggcctacctgttacttgtcttctcagtttgctgatgtatcatgtgataaacagaaagtcttaattttaatatcatagcatttatcaatctgatttctttttttgagacggggtctcgctctgtcgtgcaggctggggtgcattggcgcaatcatggctcactgaagcctcctgggctcaagtgatcctcccaccttagcctcccaaacacctgggactacaggcaggcgccacagtgcctggctaattttgtaatttttttgtagagacagggtctcgctatgttgcccaggctggtctcaaactcctggactcaagcggccctcccgccttggcttcccaaagtgctggcccgtgagcctgtgagccactgcgcctggctaccttcttttgaattcccattcagactgtgtgttgctggtacatagaaaaacaatggatttctatgtatcaagtaaccttgtaaactctcatattaagtctaataattatgtttgggttctctttgtggattctttttgattttctgcgtacacaatcctatcatctgcaagtaatgaccattttgtttcttctattccagtctttttagctttgatttctttttttgaggcagagtctggctctgtcacccaggctggagtatagtggcacaatcttggctcactgcaacctccgcctccctggttcaagcagttctcctgcctcagcctcccaagaagctgggactacaggcacccaccaccacgcctgactaatttttgtatctttaccagacacagggtttcaccatgttggccaggctgatctggaactcctgatccacctgccttggcctcccaaagtgctaggattacaggcgtgagccactgtgcccggctgatttcgtttccttgctttacttcccctggacttgctttctcttgcttttacttcctttgaatgaaagcataggaggcgctgggcatggtggctcacgcctgtaatcccagcactttgggaggccgaggtgggtggatcacctgaggtcaggagttcgagaccagcctgaccaacatggagaaactctgtctctactaaaaatacaaaaaaattagccgagcatggtggcccatgcttgtaatcccagctacttgggaggctgaggcaggagactcgcttgaacccaggaggccgaggttgcggtgagccaagatcgagccattgcactccagcctgggcaacaaaagcgaaactctgtctcaaaaaaaaaaaaaaaaaaaaaaaaaaagcataggaggcattctcagtgttccattattaagtatgatgtttgcagggagcattcggtagatatgtttatcagatttagaaagctccctcccattcctagtgtgctatatgttgaatttttataaaatgctttttctgaatgcattaatatgatcacagggttttcctcctctaatctgttaatgtggcaaattacattaattcatttttaaatgttaaaccactcttgtattttctggactaaactcaactttgcgtgatgtatttttttcatatacaattctggattgggtggtttttttttttttttttagcctcgtattattatcctcgtctggttttggtatcaagacatcgtaaagtgagttgaggcagtatttcctttttcagctgttcactggaacagttagtctaagatggagatgatcagttacttccatgtttgctggagatcatctgtaaaaccatctaggccttccttgttttttattttctgttttttgttttgtttcttttcttttctcttctttgttttttttgttttgttttgttttgttttgttgttgttttgagacagagtctcactctgttgcccaggctggagtgcagtggtacagtcttggcttactgcaacctctgcctcctgggtgcaagcgattctcctgcctcagcctcccgagtagctgggactgcaggcatgcaccaccacgtccagctaagttttgtatttttagtagagacggtgtttcgccatgttggccagtctggtcttgaactcctgacctcaggtgatctgcctgcctcggcctcacaaagtgctgggattacaggcatgagccaccgcatctggcctggccttccttgtttttgtagcttcctgcctgtccccctatagattttaaacaatgaatccaacttctgtaataattatgggaccatttaggttttctgtttcttcttgagtaatttttttattgtgggaaaaaatacataacacaaaatttgccatcttttttttttttttttttgagacaggtcttgctctgttgcccaggctggggtgcagtggcataatcattgtaacctcaaactcctggtctcaagcaattctcctgcctcagcctcctgggtagctgggactataggcattcaccaccatgcccagctaatttttaatttaatttttttttttgagacagatctcactttgtcacccaggctggagtacagtggcgtgatctcagctcactgcaacctctgcctcccgggttcaagcaatttttgtgcttcagcctcaaatttttaatgtttttggtagagatgggatcttgttactttgcccaggctggtctcccattcccagactcaatcaatcctcctaccttggcttcccaaagcactgggattacaggtgtgagccaccatgcccagcctccaactttattcttttgcatgtggatatcaagtttcccctataccatttgttgaaaagactgcccttttcccaatttgtagccttgatacccttgtcaaaaatcatctgaccatatacttgagagtttctttctgggctctggattatattctgtctctgtctttatgccaggaccacactgtaatatgttttattttgtaaatcaggaagtgtgagtcctcgaactttgttctcctttttcagaattgttttggttatttggagccccttgagattctatctgaatttaggatgaatcattctattttgagtcaatttttgataaacaatatttttctaggaacatgcttttttttttttttttttagacagaatctagctctgtcgcccgggctggagtgcagtggcatgatcttggctcactgcaacctttgcctcctgggttcaagcaatcctcctgcctcagcctctcgagtagctgggattacaggtgcccgctaccacgcccagctgatttttgtatttttagcagagacggagtttcactgtgttggccaggctggtcttgaactcctgacctcaggtgatccacctgcgtcggtctcccaaagtgctgggattacaagcgtgagccaccgcgcctggctggaacatgcccattttgtttaagttttcaagtttattagcataaagtgttttggttttattttatcattgatttattattaataaatgtcttgggtcaaaaccagatgacgttgcttaatgttcatttattgttaacctacaaaaattgcagtttcatcttgttcaatctaatacacacggaagagcatatgctgcttagatgaatcatccccactgacagccatcatggacccttctttttcccttcgcagttagtcctagcctttccttggttttctttatacttgtcccaaatatgaattagccttaaacaataaattatttacttttgcaacaaattttttggttttatttttttaaatgtgttaactagaatcaccatgctgtacatcagatctctggaacgtctccatcctgcataactgaaacttggtaccctttgaccagcattttcccatttcccctaccccagtcctggcggccactgttctgctctgtttccatgaggctgacatttttactttccacgtgagcagcgtcatgcagtatttgcctttctgtgcccggcttacttcacttaatgtaatgtcctccaggttcctccatgttgcaaatggcaggattgccttctttttaaaggctgagtagtgatccattgtgtatctgtaccacattttctttatccattcatctgttggtgggcatttcgtttgattccatatcttggcgattgtgagtagtgcttcaatggacatgcgagtgtggatattgcctcgacataccgatttcatttcctttagatacatacccagaaatgggattgctggattgtatggtcattctcactttaaatattttgaggaaccaccatgcataccattttccatactgttccaaaatgttcccttttctccacaccctcgccaaagtttgttttcttttgtctttttgaaaacgatcattctaatttgagtgaggtggtgtctcattgtggttttgagttgcatttccctgatgattggtgatgtcgagcatttttttctttttttaagatggagttttgttctttcgcccaggctggagtgaagtggcgcgatcttggcttactgcaacctctgccccccggattcaagtgattctcctgcctcagcctctggagtagctgggattacaggcgtatgccaccacacctggctaagttttgtatttttagtagagacagggtttcaccatgttggccaggcaggtcctgaactcttgacctcaggtgatccactcacctcggcttcccaaagtgctaggattacaggcgtgagcactgcacccggctgatgttgagcatttttttttaatagacctattggccgtttgtatgtcttcttttgagaaatgcctgttcaggtccttgcccatttaaattgggttatttattttttcaattttcaatttttaatttttaggagtacatagtaggtgtaactgggttattttaactgggttagaaaatacatttgcttgctattgagttgtatgagttccttgtgtgttctgtgtattaaccttgtatcagatggatggtttacaactatgttcttccattccataggctgtctccttcactctgttgattgcttcctctgctgtgcagaagctttttagtttgatgcaaactcatttgtctgtttttgttttgttgcctgtgcttttggtgtcatattgaaaaacttattgcccagaccagtgccaagcagcttttcacgtaagtttcttctagtagttttctaatttcaggtctcacatttgaatcttcagtccgttttgagttgatctttgtgcattgtgtgagataagggtctaatttcattctactgcaagtgaatatccaattttcccaacaccatttattgacaagactgtcttttgtctatcatgtattattggcacctttgtcgaagatcaatcaactgtaaatgcatagatttatttctgggttcactattctgttacgttggtgtatgtgtctgtttttatgccagaaccatgctgttttggttactatagctttgtaacatattttgagatcagatagcatgagtcttccagttttgttctttttgttcaagattgctttggctatttggggtcttttgtggtttaacatacattttagaattgctttctctatttctgtgaaaaatctcatgggaatattgatagggattacattgaatgtgtagatcactttgggtagtatagacattttaacaatattaactatcccaatccatgaacacagggtatctttccatttatttgtgttttcttcagtttctttcatctgtggtttacagttttcggtgtataggtctttcacctccttggttaaacttattcctaagtattttattttttatagctattataaatgagattgttggcttgatttcctttttggataacaaaataaatcttctttgatgatttcttttttagaaagtgcattggctgggcgcagtggctcacgcttgtaatcccagcactttgggaggccgaggtgggcggatcacaaggtcaggaatcgagaccacggtgaaaccctgtctctactaaaaatacaaaaaattagctgggcatggtggcgggcgcctgtagtcccagctactcggagaggctgagacaggagaatggcgtgaacccgggaggcggagcttgcagtgagccgagatagtgccactgcactccagcctgggcaacagagactctgtctcaaaaaaaaaaaaaaaaaaaagaaagtgcattgttagcatatagcatatagaaatgctactaggtgaggcatgatggctcacacctgtaattccagcactttgagaggccaaggcaggaggatcacttgagcccagaaattcaagaccagcccaggcaactaaacaagaccctgtctcaataatagcaataatattaatactaattagtcaggcatgatggtgcacatttgtagtctcagctactcaggaagctgaggtgggagaagcccaggaggtcaaggctgcagtgaactgtgattgagccactgtactccaggtggggtgatagagcaagattctgtctcaaaaaaaaaaaaataaaataaaaaataaaagctattgttttgtatgctgattttgtatcctgtaccttgactgaattctaacaatttttcggtggagtctttagggttttctgcatacaggattgtgtgatctgcaaacagagacaatttaatctctctctctctcttttttttttttttttttttacgaagtgtcactctgttgtccaggctggagtgcagtagtgtgatctcggctcactgcaacctcagcctctcaagttcaagtgattctcctgcctcagcctcccaagtagctgggattacaggcatgcaccaccacacctggctaattactgtctttttagtagagatggggtttcaccatgttagccaggctggtctcgaactcctgacctcaggtgatctgcctacctcggcctccgaaagtgctgggattatatgtgtgagccaccgagcctggcctaatttgggtttttaaatgtttttttttttcttttctcattgctgtggctaggccttccaggactatgctgagtagaagtggtgagagtgggcatccttgtcttgctcctgatcttaaaggaagagctttcagcttttcaccattcagtatgatgttagctgtgggcttgtcatatatggcctttatgatgttgaggtatattccttctatacctaatttgttgagagtttctttttaattttgtttttttggtagagacagggcctatgttgcccaggctggtcttaaactcctgggcccaagtgatcctcctgccttggcctcccaaagtgctggaactacaggcacgcaccaatgtacctggctaatttgtatttgtttgtttgtttgagacagggtcttgctctgtcacccagactggagtgcagtggtatgatcctggctcacagtagcctcgaactccagggctcaagcctccagagtagctgggactacaggcacacaccaccatgattggttaatttaaaaaaatttttttttgtagaggtgtcttgctatgttgcccaggctggtctgaactcctgggctcaagagatcctcctgcctcggcatcccaaagtgctgggattacaggcatgagccactgcacctggccaagagctaatttttttttttttacatcatgaaagaatgttaaattttgtcaaatgctttttctgcatcaattgagaaatgattttattctccattctgttaacgtggtgcatcacatttattggtttgcatatattcaatcacccttgtatcccagggataaattctacttgctcatggtgaatgagccttttaatgtgctattgaattcggtttgctagtattttgttgaagatttttgcacctgtgttcatcagggatattggcctgtagctttttttcttttagtgttcttgtccagctttgatatcagggaattttctgaccttattaaatgagtttggaagcgttccctcctctttagttttttggaagagtttgagaaggataggtattagttatttaactgtttggtagaatttaccaatgaagccatcaggcctgagcttttctttgatgagagactctattacttgtccaatctccttactcattattggtctgttcagattttctatttcttcttaagtcagtcttggtaggttggatgtgcctaggaatgtatccattttttctaggatacccaatttgttggagtataattattcatagtagtttcttttttttttttcttttttttttttttttgagacggagtctcactctgttgcccaggctggagtgcagtggcacgatctcagctcactgcaagctctgcctcccgggttcatgccattctcctgcctcagcctcccgagtagctgggactacaggcgcccgccaccacgcccggctaattttttgtatttttagcggggacggggtttcaccgtgttagccaggctggtcttgatctcctgacttcatgatccacccgcctcggcctcccaaagtgctgggattacaggcttgagccaccgtgcccggcctattcatagtagtttcttacaatcctttgcatttctgtggtatcagttgtaatgtctcatttctgattgatttatttgagtcttatctcttcttagttggtctagctagaggtttgttgattttatcttaaaaaaatcccaactcttagtttcattcatcttttctgttatttttctagtctctatttcatgtatttctgctttgatctttgttctttccttctttctgctgactttgggcttattttgttcttccttttctagttccttggtgtgtaaagttaggttgtttatttgagatctttcttacttcttttttcttttttttttttttccagtgactctcgtgcctcagcctcccaagtagctgggactacaggcatgtgccaccacgcccactaatttttgtatttttagtagagacgggttttcgccatgttgctcaggctggtcttgaacttctggcctcaagtgacccaccaaccttggcctcccaatgtgctgggattatagacgtgagccaccatgcccagcctctttcttatttcttaatggaggcatttaaggctctaaacttccctctcggaattgctttgctgcacactgcattttgtatgttgtgtttccatgttcatttgtctcaagagatttttttttttgtttcccttttgatttcttctttgacccattggttgttcaggagggtgttgtgtatttccacaaatctgtgagttttccagtttgctttctcttagtgatctcttgtttgcggttgggaaagatgcttaatgtgatttgatcttcttgaatttgttaagacttgttttgtggcctgacatatggtctatcctggagactaccccatgtgcagctgagaagaaagcgaattctgctgctggtggatggaatgttctgtgtatgtctgctaggtccatttgctctagagcagtggtccccaatctttttggcaccaaggaccagtttcgtggaagataatttttccatggatggagggttggggggtatggtttcaggatgaaactgttccacctcagatcatcaggcacaacctcgatcccacacattcgcagttcatgatagggttcgtgctcctatgagaatctgatgccgctgctgatctgccaggagatggagctcaggcgggaatgctcacttgcccaccagtcacctcctgctctgcagcccggttcctaacaggccacagactagtactggtcagtggcctggggttggggacccctggtctagagtgttgttcaaatcctgcagcattatttttttttaacttccctataagtggaatcatactggatatatttttctataacctgctgttttcactccacatgacatttgtgacagacatccaagttgatgcacataaccgtagtttattcatttatttatttttttagacttctatggtctgactctgggacatttctattgctgtatactgtttcattgtatgactctaacatagatcttttatctgttcttctgctaatggacacttgggttgcttctggcttttgcctattaaaaaacatttaaacattattttaagcattataaacaatgatgctgtgagcgattttgtacatgcaatctggtgtctaggagtgaaattgttagcttctaaatgtgcacatcttcaactatactgaataatgctcactgttttccaaagtggttgtcccagtttgcctgccccggggaagtgtgagttcctgctgctctgtagtactgctaacacttggtattgtcagactttacatttctgccaatcagtggatgcaaaaagatacttcactgtgggccgggtgcgggggctcatgcctgtaatctcagcactttgggaggccaacgtgggtgggtcacctgaggtcaggagtttgagaccagcctgaccaacgtgataaaaccctgtctctactaaaaatacaaaaattagccaggtgtggtggcgtgcacctgtaattccagctacttgggaagctgaagcaggagaattgcttgaacctggggggcagaggttgcagtgagctgagattgtgccattgcactctagcctgggtgatagagtgagactccgtctcaaaaaaaaaaaagggtattttactgtggcttaaatttgcatctccacagaccttctgttctatctctggtcttctgtacaaagtggggcagagatatgggcatctagcatcttctttgttttcttcttctttttttttaatctgcatagccagtgcaaggacagcagcttcttatagagacttccaataaatcatcttgttctgcactccccaacacatacacacacattgtttctgagttatctggtgcctccgattcttgtgcaaacccaactttgccactggctgcctcccactactttttttcccctaagtgttaaaacatttattcgagatggcaaaattcctacaagttttcctagcatgtaattgaggaaaataacacaatttttgtaattattaaatgtgaagggaaaattcttttggatgtatttcttttcctgaaatgcagaggtggagatgtcaggttggtgaaaggaggcggtatttcaaatggcttcttttcctggtgcctggtagcctttgaccccacgacgtatcatggtgcaacatcctgctcttgtcaactggggtcaggtttctgggaaaggcaggttaggttagagcccctgtgcaagctgaggcgggacattggctccttgggaccatccatgctgagcccctcctggacaggcttcataatcctcaggggagcatgtgccccggcataaagactactcttctagaacgtcaaatcagagcactggcaagggagatgcagggtcacatggtgccttctccctcctttctggctggagacttagaccgttccaaacagatgatgatttactgcatcaccgagcatgggcagcatatgagaccgaaaacaccctcaatcacatcattcttgtattcacctagtggtcgctgtgtacctcccacgtcaggcactgtactaccagacactgaggatccagtggggagcgagagggactttggggactgagtcagtaggacacgggctggtgggttagggaaggatgagggagacagagggtcagatgatccccatggttctgcctggggaacctgaagggaagtcagaaaggaagccaggttgaagagggatggcaatgagttttgtgtttggtctgcaagacagagatgccgggttggggggagaacaggtaggaggtgtgcatcacaggcaaaggcaattgctctatgggcctgggttttgatgggaagagacgctaaatcatagtgcatgattctttttcaaaattgtaatgcaaagagccctcattgaatctgcatttgatagcatgtactgtgcaagtttcgggggtatcaggaagaagaaacatgctcctttgtctcctgaagctcacaggctagtggacatggcagacacgtaagagaaggcagaagaggtcagcccacagagaacagctttgggtttgcctctgatgctggccctggcccagatcaaccaaacctaatggaaacagagagctgagaaagcgggagagttgagctcactgatgctcggattttacagatgaatgtggaggcggtttctcccagtgctgacatccaggtgctgcgggtgccacagagaaacatggaggggccttctggagaccaccgcgcccagcatccttcccgcttttagaactggagcgagacaaccatgtgtgctatcactgcttctttctttacagtgtcggtccaacaccgtaatggtctgacagccctgcaggctggaagcccaggatcacggtgccagcagggttggtttcttccaaggcctctcatctgggtggtggcctcatgtggcctttcctctgtgggcacgtgcccttggtgcctcccaccacttttttccaagttcacgctgatcccttgaatcagttatcactcccccacttgttttccagcttctgtgatgttcctggcaggcgctcctctcactctctgctgtgaactctcccttttacatctgcaatccctttgcattccttttagctgaagttgttcccactcatgtctttcgcccccaggtgccccgatgtttcagctctcagtggtgcctgcagggagatccctctgtacttcataatattatttttattttttacactttttttttttgagatggagttttgctcttctcgcccaggctggagtgcagcggtacaatcttggctcaatgcgacccccgccttccagtttcaagcaattctcctgcctcagcctcccaggtggctgggattacaggtgcccgccaccacgcccagctaatttttgtatttttagtagagatggggtttcgtcatgttggccaggatggtctctaactcctgacctcaggtgatccgctcaccttggcctcccgaggtgctgggattacaggcgtgagccaccgcgcctggccacactttttttttcttttttaatttcctcatagtactgcttgggctacatggcttaagcttttgtacatagttttcattgttcggttctaaatgcttttagattttcattctaattcttctcggaccagtgcattattttttatttttttaatttaaaaaataatttaatttagttttatagagatggggggtctcactatgttgctcaggctggtcttgaactcctgggctccagggatcctcctgccttggcctcccgaagttctgggattataggtgtgagccaccgtgcctggccagtagtgtatctttaaatttccaaacataggggagcccttaattttagtttggttgccaatttatgcctttattctgttgcatcaagaacatggctggtgtgatgcaagttcttttgctatttgttgagtcttgctttgcagcctaggacatggtgttagtaaatgtccaaggtgaacttgaaaacaatgtgtggtctgtagtttttgggtgtccactaaatcaagtttgttcaacttttccatatttttttattttatttttattttttgacagagtctcactctgttgcccaggctggagtgcaggggcacaatctcagctcactgaaacctcaagttcaagtgattctcctgccttagccacccgagtagctgggattacaggcatgagccaccacatctggctcatttttgtattttttattttagtttcagcacgttggccaagctggtctcaaactcccgacctcaagtaatccgcctgccttcgcctcccaaagtgttgggattacaagcatgagacactatgcctggcccaatttttctatattcttactcattgagtctgcttaaaccagcagttccagtgagaagtggtataatttcctgcgtggagaatgtgctcatttattcatttttccttttcttgacacttttttgttttgtagtcatttggggctctatcattatgcaggtgcacacaagatcagaatggctaatgcttcttttttttgttttttgttttcctgtcgcccaggctggagtgcaatggcgtgatcttggcacactgcaaccttcgcgtcccgggttcaagcagttctgtctcagcctcccaagtagctgggactacaggcatgagccaccatgcctggctaattttgtactgcagtagagatggggtttcaccatgttgttcaggctggtctcgaactcctgacctcaggtgatctgcccgccttggcctcccaaaatgctgggattacaggcgtgagccaccgcgcctggccgctaatacttcttttaaaataattaacttatttatgtatttattctttttcccccacccctcccccgccagtgaatgctttggaatgaatacttatcagtatgctgcaaccacttttaatcctaataatgattttgccctggagcctatttgtgcaatatgagcttctctccactagcttccttttggatggtctttgccagatgtgtctccttctatctgtagtaattagagccattccagctatgtgtcagaaataaacaaacggggtttatgatcaagcatgggcgacttacacaatcgtcaaaagaaatggaggaacaactctcagccctccgaatcggccacctcctgggatcaggaataaatcctaatctcaaaatgcaggtaaacagtctacctcttgtcccctaaatgagatgccaagcatgcccctcccctcagccaggctgtctccatccaaacttcaatgaccactggcctccctgctgacccacgtcccactgaggagccccaagctctgaaccaactgcctacacaccatcccctcgggctgcacctgctccccaggcctgcccctcctttggagctgcctctgtccaccaagggtgctgtcgctcacctaaccttccaagccagaacccagtggtaccttgctgccccctccactccctgaagaagctgcccccatgcctgttgagttcttccaactgctcgaaccttctggaacttcaggcctcagcatgtcttgtctgggtggctgcaatggctgtgcttgcttctctgtctctctccatcaatcaatcaatcaatcgatcaatcatctatcaatcaactatccgcctattaatctataatcaataatctatcaatttatatcatttacttatataatcaatcattgatctatcccatgtatcttccttttatcatgtctatccatctatctatcatttatgcctctatcatgtctatctttcaatcatttatctatcaccaggcacagtagcatgtgcctgtagtcccagtaactcaggaggctgaggtaggagggctgcttgatgctagcagatcgagtccagactgggcaagatagtgagatcttgtctctaaaaaaacttttaaaaccatctatcatctctctctattcatctgtctatccatgtatctatcatgtattttatctatcacttatcacctatgaatcatccatcatctatcaatcaatcatctatatcaatcatgtctatatatctatatatctatgtatcaatttatccatcaatcatctgtttttgaggcgatattcacaaaatatacaatcaatccctttaaagtgcataattcagtggcatttagtatgctctatagttcgagaacattttcttcgaaataaaaagaaacccgaggctgggtgtggtggctcatgcctgtaatccagcactgtgggaggctgaggcaggacgatcgcttgagttcagcagtttgagaccagcctgggcaacatagtgagatcctgtctccaaaaaaaaaaaatcacaaaattagcagggtatggtggcacacgcctgtggttccagctactcaggaggctggggcgggattgcttgagcccgggagatcaaggctgcagtgagttatgactgcgccactgcactccagcctgggtgacagggtgagaccctgtctgtctcattaaaaaataaaaaataaatacaaaattttttaaaaaggactccccccgccacattttccttcccctgccccagcccctgacacccacttgtctgctttctgtcccgatgagcctattctggacatttgtgtctggcttctttcacccagcacgaactctttgaggtctatctgtcgtgttatggcagaatggcactgtgccttatggacaggctgtttgtccatttgtctgttgatgaacactcaggctgccccacctttgggaggctgtggccatccatgcataaaggtatggccgcacagctgttctcagttctcgtgcctctgaggccagatgggctgccgcaccctattcccaccagccaccctcacatgcagccacgtggcctgcagtactcgacactgcttccctgttgctgaaagctcctcggtggcctctgggctaagtcctgtctctgtagtgtggcctccaaggcccgccggccgcagccctcccttcccctgccctcccttcccctgcatgcagcacgaacaccctgcgctgtgctcccagttccccccaggcccctgcacaagtggccgcctctccctagaagggccagcagcaccctgtgtggcagcttagacatcccttctcttgccttcgtgctcctcccacagggaccagcatgatcccctcccctagtcctatttgggctcagccagtatttctgtgcaatgttgttgcaggttccgccccgccaccgtcacaggaatcctaagagcattggcgtgaggctcggcggagggcatgctggaccatgtcttctggtgactttccccctcggaggggcttgggggtcaggcccactcctttcccaaactcactctttcccccacaggcaacccactccctctcctccatctctcctcgagacccacagcagacaccaccaggctctgaggcagggaggaaggactgcatttgccagtggaggcttttactggggggactgggggtggtgcccggcccgagggctgagggcccgggaaaggcacacggtggcggtggggtctctctcgggcaggcgctggctccgcagacagctccccctggtgacccctctttggcactgagctgggaacatggtgtccgcactcctggctggcaagcagaggcccgtgtgccccggtggcggctggcagtgtaggctggcggggtgacggccgcaggggctgggtttggcaccggtgggagccggggccccacgggactcagaggctgggccgcccccgctgctggcacggtagtcacattggccacggagatggctacgaatagggaatccaataaattaggctgtagaaagaggtggtgaggggccgagggggcggggcctgcattctcgcttggcaggcagtgctgtgcgtccctctcccctctcccgtgggatctttggggctcttgtgggggagaggatgcaggtgaggcgctctgtgtgactgtgggtcccactgggcggcttttatggcatcccacggaacgggagccttggctgaccaccctcaggggatggaccatggggtctttgagagactgacgaggagggaatcatggggactcgagtctctggagggaggccacctgcagtgccaggggctgtggcctgacgggctcctggggctcggctgcgctgctgtgtggccagcactgggccccttgtaccccagcttcctccacggagcaaagtagaggactcactgccctggacagggcccagtcactgtggaacagcgcccccagggagtgggagggacagggcgagggttacgcagggcgccaccctccacatctactttcccgagggcgggaagggttttctaggaggaggggccaggcatgcaggggcggggtgcgtgcatgggtgggtgctgctgtctccttcatgtgatccgagcttgggggcggggcaggggccggggacggttgtgtcaggtggaggcaccctggaggccaccagggccttgcgggctaggtgccggcacatgcgctggggccacggcctcgcccaggatctggcagagctcctggaggcgccgctgcatcttgggaatgcccgccagctgctgctccagccgctgcttctcctccgtcaggctcaggcgggcagctgagtccagcttctcgaacttccagccgccctccccatcgaactgtagcaagtgtgtgtggtatttcctggccaggagagggacagggtcaggggcacggcacgggggctgctgatgacagccgcctgctgctgccgggcccgccaggccacctcctcccctcaggcagccactcccaccgaccccaggcagggagacagggcacctaccacagggagggccggtgggtgatggagagcagggcaatgcccgcgtccttggccgcctggaagatcttgccttccacgtcgatgctcacggcgctggtgcattcatccaggagggcgtacttgggcctgggggtccgggccgagaggagagtctgtgcaccctccagggcccaacaccccagcccggctcaggctccactgagcccaggcctccccacagctgctacttccccttccaggggaccccagggagcctgccggcccggagtgctcacctgtggtagaacatgcgggccatgccgattctctgcttctcgccacccgacaggacgtccttccagtcacacatagcctcccaacctaggcgggggcaatggtcttggctcagttccaccagcacccagacccgggggccagccggggagctgggggagctgcgggaatgagctagctgtgacgacagggcccctgtgcctctgcgtccttgtctgtctgacaggcattaatcatggaggagtggggactggaatcgtgccttcccccagaagagatacggtggagtccaagccccaacacttcagtgtgaccttatttggagacagggccttcgcagaggtgatcacactaagatgaggtcatcagagtggaccctaattcaatatgactgtgtcctcataaaaagggggtgtgtgggcagaagacatgcacaggggaacatgaggtgaagatatacagggagaagtggaccatctgcgagccgaggacagaggcctggaacacatccttctgtcatggcacccggaaggagcccaccctgctggcacctggatctcggactgctggatctaggagacaatccatccctgcggtttatggcagccccagggcacccatacagttccttggcacagagctccagagcggcctgagtgctctccccagaccgggggcttgtcacccacaggggttgggcctcctgtcactgccccgtgtcagcactttggcaaggctcgagtgggctgcttgaacgagcaggtgagccggctgctccattaggtcggggcgctgcggcagaagcggcccttcctgtcttctcgcccatgctgccttccccagcggcccagggctagaagtggcaacagggcatatggccacccagagtagagattacgcttcccaggtggccttgtgatgaggtgtgagcatgagactaagttgtggccaatgagatataactgtaagtattcaatatggcggcttctggaaccttccttaaaagaaggcacataccttttgccccttcccttctacttcctccatcctacagcctgggacatgatgtgagggctgcagcagccctcctggatcatgaggtgactttgggaacggaggccaaacacagcagagtgacctggtagaaaatcctcgagccctggggccttcacagagcagggccagccctggcaaccgtggcctggctctcttgggacctaacagctcagtaggataaactcacagatgatcttagccactattgcggggaggcccgttctgttcctcgcagctcaactccatcctaatggctcatgctggccggccacaggccctgggcattcaggctgccacagaggcgggaggggccacgtgctcccaggctgagggcagcaggagcaagaggcagggccgggccaggggctgctccactgccattgccacctgtgtccccgcttcctccacaggcaggtgacaacaccccggccatttcctgcaggagccacttcttctcatgttgccaccgagggagggcttggtgcccgtgcccttgaaccgtgaaggggagccccagcaaggcgaggtccttgcccagggccatctcgcacccagcagtgcaggctggaagcagaacccagaggctcagaattcaaagacagaactgaacactccatctactgtgtccctgtagctgcagccccctctcctcctccgctcttccggcccgacagacactgtggacaagcagtattccttgataagcccaggacaagacaacagctcagtctggcctccttttcagtgaactcatctctgaatccacctgactctgctggccccagccccctccaagcgtctgcacaaacctcttgacagtagccatcactgcacacatgtgcctgcccctcccaggctgcccctgcccaccaccccatggtccttccaagagcgtctgatcctgctcagggaaagcctaggctcccgcctggtcccgagggccctctgtgagccagcctctcgcaccaccaagccttcggaacgcactccgccctgctgcccctggcttccggacggggtaaccactcagcattctgcagggctcagctcagacctcttttctctgggagagggtatcctgggtcccccagtgaggtgcacatccctgctaggtgcccccttccctagagcacctggggccatctgtgtggtgttggtcctccctggtagcagcctctgccccgccccgtggcacctggcactttagactctggatgttgaggtaatcttcactccctggaggccaagggagaggccagggtgggacaaagggtggctgccagccccaggcctcctacctccctcccgctgcaggatgtggtgcaggtgcacgacgtccaggatggcttccaggtcctgctccgagtagcccttcctttgcatgtcctccactgagtccgggtagatcacctggtcacgcagggagcccacagacatgtagggcctgtgggaaagctgggtgtccacggagggaagggccggctctgcctcccccaagatactctgcgcctcccaggcagtgtccacatgccacgctcacacgcatccacacgctcacatcgccgcccgtgcacacaccccacacagatccaaaacagggcagtggatcgggcgggtttggagggagcaggaaccacagcccgtctctggctctggggacagtgcctcagtgtcctctcctgaggtgctgactcttcaccacttcctgggcctctgcaggaagccatgtgtgagcgcacaggcaggaagaggtggaggagaggcgcacgggcttccttacctctgcgggatgtagaacatgcgctggggtgggggcttgtagagcacaccaccgtacgtgggccagagcccacccaggatccggaacagggagctcttgccgcagccattggggcctgtgatgagcagatgcatgccttcctccacctgcaggggcaacagccgctgacgccagagagcgcaggccccttcccgtaccctatggcctcctgaccagccttgagaggctcccaatgcccgaggccagcacgcaggccattcttgatctcttgataagggacagcagggcctgggggatggggtccagcgtccacagccctagctaaatttggctctcgctaaatgcctggcccaggacacaggaatggacaagccccggcccagtcctcaggccctgacacgcctggagaacatggtgccagcacaagaggaagggcctattctgccacagctgaatgagtaggtgtgttccaacacagccagcgccgtcctcagtcccatccgactcccacttcaccaggaatccaagtgcagggtcaactgtcagccccctttaaggaactgccctgaaaggcactttgttttcaagagacgagacctcactctgttgcccaggctggagtgcagcggtatgatcacagctcaccgcagtctccaactcctgggctcaagtgatcctcccacctcagcctcctgagtagctgggcctacagatgcacgccaccatgcctggctaatttttaaatgttgttttagagacagggtcttgctatgttactcaggctggtctcaaactcttggcctcaagcgactctctcaccttggcctcctgagtcactggggacaaaaggcagtttctttcttttctttttgagacggggccttgctctgttgcccaggctggagtgcagtggtgggatcatggctcactgcaggctcaacctcctgggctcaagagaccctctcactttagccttttttttcaagtggctagaactacaggcaccgccaccacacttggcttatttgtgtatttttaaaaatttctgtagagacggggtttgccatgttgcccaggctggtcttgaactcctgggcttaagcgatctgcccacctcggcctcccaaagtgctgggatgacaggcatgagcgaccacgcccggcccaaaaagcactttctttatgtctctagactgacagtacagaccccactgcctccccaggtgccagagtggcccagagatgccacagtggcccctgggctctgcatcatggacctcaggctcctcaattcactgactccatggtcctcgctggagctaggaaatgcctactttgggaaaatgccggccaggctggaggcgggctgtgtgcagggaggaggccaggggcctggagtcagtgaagttcacggtaacaacaacaatgctacacggggctcctgggaagacttgaggccgtggtctttagcttacctcaggcagtgtcatgggtggaactctgtcctctgaaattcctatgtgggaaccctaatccccactacctcggagtgtgagcttatttggaaacagggtcattgcggacgtgatgagttaggtctgcatgaggtcattctgcagaggggtgggccctaatgcagtgtgacctgtgtcctgacagaaaggggagacggagacacggacacacccagagggagagcgccgtgtggagacagaggctgaggccgacctgccgtggcagaagccagggaagcccgcagatgggcagcagagcagaagctgggacagaggccccgagcggaggcaccttctcggtccttggcagaagcccgccctgcctgcgccttcctctcggactgctattccccgagccgggagagaggccatctctgctgggaaagccactcaaagtttgtaacgctttgtgaccgcagccacaggatgctaatgaagccacctgactgtcccctcctgaagggtggggcctgggccttgccccatctcgcatacccggctccctgagcatatgtggccctgcgcgcaggggccccatgagcttgcccgctgcccctgcctgcttgtgctgcccggggccagcctggaaaccaccttccttggactcactggtgatcagctcccccgacatcctaggaggggccgctgcgagcggtgaggggtaaccacctgtgccggccccctcctccctggcatgcccctcctctctgcttcctcctgcgtgacctgcccctcaggcccacggcccctcactcctctaccctcagctgcctgcccactcgctcacagcaactcctgggcaaggcttcatcccacccccaccacccccagggactctgaccactcttcttgtgacccccactgtcccttgaacagctgtctacctggagaccctttgtaacactttagtgcccctccacagtgaagactccctgagtgcaggtctcctgatttacctcgggtttctggtgcccggctcagagttcagggcacattggttaaatgagtgaatgaatgagtgattccttgtcacttctctacctgtccctccaccccagtctccccctcactccattactccccagccctgtccaaacccctggctggggacacaggtgatctgtggattccttgctgtggccttccgagggaggtcgagcggcaaggtttgaaccagagcccccccacccgggtcttggctttcttaggagtgtggggagttggcatcagatgatagggccaggaacgccggggtgaaccttggtcaatcctggtatcactagtctcttttatgagccctgcctctgttgccccaggatgaacagtcagagacacgttggtctctcaccttgaccttggcccacctgccacgtacatctagggacaatggctgttgccagcacagacaggcgggaagccaagggctgaggcttgcatatgtgcgtggctggcgccctccccgctggacctaccctgatgttgaggctggccaccaccacctctcctgagggcgtgacgatggggatgttctcgcagatgatcccctgttccacatccaccacctggcctgcagagacagcacagcggggctggggtggagagggagtggtggcgacccctctgcattctggggagtctgcgtgcccctggctgcacgccctcattcccatccctggcagcatgccagctggttcctgaccagcagcctgtggtccagggtccctagggaacacagccaggtcttccaacaagctgaactcttcccccagtgtctaatacagtgccctgggccgccactcccttctgcagcacctgcctcccgtggcagccagcagctggcacactgactggaactttctcttgctgtcctgcatgggtgaggggaccacatcccccttgttttgaatgaataatccaggctgaggccctcaaagggcgagtcagtacggtggccggcagctactgtctgggaaggaaggcgggcggaccagcacctctctgcaggaaaccctccaggggcccagctcgaccaggccgaagtcctcaaagaccctgcccggcagccctcccgtcctgggtggactgggatgggccagaagcacatggaggtccctgagtgagggagcgggaataggaggagctggggcagcaggtcagcacctgcagcagcagcaggggcggggtcactcatagggaggggacagccttacctcggatcttcagggggccctccacacggacaccagaccggcctatggtcccagaccccgcctgagcgtcctctagctccctgggcctcttgaagtgacagcgctgaacatcttcaaatacctggaacatctcgtgcacccgggctgtgtagccagccagctccgtcacctgagggagggtgaccctggctcagcccctgccagttgcagggagagaagcatggcaaggatggcaagggtggggctgggccaggggtacctccttgtacgacgacatgatccgctcaatggcatctgcagccgctgtcaggaggttgcgggcaatagtgaaggcttctgtgcgctcgctcaccagctcctcctccttcttttccaaggctgccttcttcacggcctctgcatctgcaaagccccagaggggtgggtggcggggcggggaggggcagggcagagacagcggaaagtcaaaaatgagccgctggagagaaaggcgaggctcttctgcaaatggtgccggggcaaccagctctctctctctttctctctatgtgcaggagagggacccctcacaccatacagacaaaccaacccagagcacatcacaggctgatgtgtagtgtggcccaaagtatgaaactctcagaagaaaatgggataaaacttcacgaccttggatatggcaatagttccttcactaggacaccaaaagcatgagcaacaagagaaaaacagatcaactgaacctcattcaactcaacacttttgtgcaccaaaggacaatatcgagacagtgaaaaagacaacctacagactgggagaaaactctggactggtgaaccacacatctgatgagggtgcagtatccagaatatacaaagagcttttacaactcagcgacagagataacccgatcacacatgggcgaaggacgtgaacagacatttctccaaagaagacatacaaatggccactcaacacatcaaaagaggctcagcgtcattagtcatcagggaaatgcaaatcaaaaccaccaagagatactgcctcacacccactaggtggctagaatacaaaggagatgataaccagtgctagccacgatgaaaaggtggaaccctccaacactgctggcgggaaggtaaaatggggcagccactgtggagaacagtctcgcagctcctcaaaaagtgaaacgtccagttaccatgtgacctggcaattctactcctagctacacacccaggagaaacgaaaatatctgcacacatagagacttgtccatggatgttcacagcagtgttattcacaatagccaaaacatgaagaaacccaaaatgtccatcaagggatgaatggataaagaaattgtggtctatgcacacaatggaatattattcagccatgaaaaggaatgaaggactgattcatcttatgacatggacgaatcttgaaaccatgatgctcagtgaaggaagctagtcacaaaatgccacagagcacatgattccatttctaggacatgtccagataggcaaatccacagagacaggaagcagatgagtgggtgccaggggctggagagagggaatgaggagtgactgttcatgggtctggggtttctttgggggataaaataaaaataaaacattctggagttagtgatgatggctgcacaactctgtgaatgaatttaaactgtacatggaaaaggaagaattgtatagtatgttaattacgtctcaataacgttgatttttaaatgcaccagtaggcatctggttttgtttctacgtacagccagctccttccaccggccctctgtcctgcaccactgatgtcgcccctcctggggcacatctgaactttgtcatccaacgcccagagctgtttggctttgaaacgccaactttcttttttttttcttttcttttttttgagatggagtcttgctctgttgcccaggctggagtgcagtggtgtgatcttggctcactgcaacctctgcctccccaggttcaagggattcttgtgcctcagcctcccgagtagctgggattacaggcacccgccaccaagcccagcgaattttttttgtatttttagtagagacgaagtctcaccatgttggccaggctggtctcaaactcctgaactcaggtgatccacttgccttggcctccaaagatgctgggattgcaggcatgggccaccacgcccggcctaatgtcccacttcctgaccgccccctctaggccatggtttttgacctctgggccagcagccgtattgtttggtgtctgcttctcccaggagctgctcctgtcttaatttgcttttctgtcacactctaggccccgtggcagcacccctgaccctcatcaatggccttgactctcagtttcttgatccttagattccccacaggagcagaggtggggagcaagggcgaaggccgcctctgagggtgctggggtgtggctgaagtggtgggaatgtcctgtgaaggacccgaggactgtatccaggggtgggtgtgatcctgagggggaagcctcagggatcattggctgggggctgggggaagacacggaacgcagtatccgctcagggccatgcagggtggaaaggggcctggcccgggaaaccagggaactagattgggctggcggggcggggatgtgaatcctaaaggtcgaaggccttggaccttccttcccacggtgctctcaaggacacagccctcctccccaggtgttctgagagctggacagtcgctgtggacaaagggaagggtctgcaagtctttgtgcccagggcatcctggcgtagaaccagctgccttctgcaggttctcttggagccttgggtgaataaggccagggccccagagctggacagagcaaggcctcagggctggagtgggagccacaggcctgcccatctcctgagcccacctgccttgcacaccagcccagcaaagcttatctaaatcttccaaccggtaagagcctgccttcccacccagtgcgctccacctccttgaagcacctggagccctcactagccacccgatgcaggggacacagcagggacaaaacagacaaaaatccctgaccccatggagcttgcagtccatggcagggagagagaaaagcgccactgacggggtgtcgagtgcttgggagagcagtggggcagggaaggagacaggaaaggtggcggtgggcaggccgggccttgcctaggggggctgcgccatggggcagcagaggaaagagtgctcctggcacaggccccaagacagagcaggcctggcatttggggaaataagaaggccacaggaccaggcacagtggctcacacctataatcccagcactttgggaggccgaggcaggtggatcacttgaggtcaggagttcaagaccagcctgaccaacatggcgaaaccccatctctactaaaaacacaaaaattagccaggcatggtggcgtgtacctgtagtcccagctacttgggaggctgaggcaggagaatcacttgaacccgggagatggaggttgcagtgagccaagatcgtgccactgcactccagcctgggagacagagtgagactccatctcaaaagctccccctccaaaaaaaaacagacggccacaggacagagcctatcaagccaggggaaagggaatgcttcacagccttcaaaggctgctggctctgaggaccaccagagcagggccaggagcccacaaagcctggcacagcagaggctcagaaaagtcctaagccttcagggcagggagcagcccgatgtgaccaatggcagccatggagcgaagcggctgcaggtgctgtctcgcgggctgtctcggtgcccggggctaggtgcgctgactgggctgggcacctacgccagcatcaaggctgcccttgatgtgcagtccccgaattagatccttcctcttggtgagtcacccagaggatgacacagacagttgagggcatggaagccccgaggtggaaacaggaacagggagagaatcagacttctgtttataaatcgaaaaccctcttcccaccaaactgggtaaactacgacactatttcgagcagagccaagcttgacggaaagcaagggaaacttctgggagcaaagagaagcagacagccaggtgatcctttgatagccccagaggcaggcagggcaaagaccaggaagctttccttgcttagcctgggctctatgcccaatgaacaaaaagcctcctctgaaaatttgtaacaatgtgcctggagttcaaatgaattcaaatgaaaccacctctcaattcaggaaccatcccctccgcactaactaatggcctccaactgcttaccctggagtgcttggccaaaacagaaggacatttggacttacaccctccattgaggccacaccaatccccatagaagttctgttgcaaaacccacaaggaaatgatccaccatgagtgaagaccagcagacagaagacaggcgaatgatactcccaagaactgaagctaaccaaaccatcagatagagacggtggggtaagtatgactaacctgatacacagtataaaaggagcagtcaaaaagatgagcaaataagacacagaaacagcctgacatttctacttgaaaaaggaaatgtccattttcaaattcctatttgaaatagaatgaaatagaacttacaaaacagccactgaaatgtgaacaaaattccaattagacatggccaaagagaaaactggtgaactggaaaatgagcaaacaggaaggcctcagggcatccccagaattcagcacagacagtgtgagatgggaaacagtaaacagaaaccgaaagacacaacgaagagagtcagaagtccagcactggctgccagttctagaagaacaggaaaaaagaatgagagtcaggcaatatctgaaaagctaatagctgagaatcttccagaatgattgaaaaactcaaatattcaaaggacatataacaagtctcaagcagaatcaacaaaaactgacacctaaacatgtcatagtgaaactgcagaatgccaaaaagaaagaaagtgatcaaagtacccagaaaaaaagaaacacagggtactcagggaggacaatttgttagcagctacagatttgtcagcagctacagaagaagcagggagacaatgagacattgtgaaagggctgagagaaaagaacagtccacctagactccattgcgcaactcaactttagcttgggaataagggtgaaatagaaacattttcaacaaaaataatcaagaatgacaacagcctgggtgtggtggctcacgtctgtaatcccagcactttgagaggctaatgcgggaggaccgcttgagcccaggagttccacactagcctgggcaacacagcgagaacctgcctctacaaaaaacaaacaaacaaacaaaaaactaaacaacacaaagaattacaataaaataatcaagaatttcccatgacaaaacccttgctgaaagaaccttttttaaaaaccaaccacaactagaagcactgatgactgtttgtcctgagcatagttgtgagttaaaaaacaaacaaacaaaaaactaaaaacatgtctatctggaggaagataacagaacatagaagagaaattgagatgtaggaacgaaatggtgagcacagaactcagcaaacatgcgagtgagtttcaacacgtgtggataaggcgatagcaaagaggaaaaactaggtacaaatccaactcttggctgggctatgatgccatgccccacggggctgcttctgcgttctaaggtccaggagaaggcggagctattgattaacctaacaagtatgcgtgttgatcttttattttttatttttatttttatttgagacgaagtctcgttctttcgcccaggctggagtgcagtggcgctatctgggctcactgccagctccgcctcccgggttcacgccattcttctgcctcagcgtcccgagtagctgggactataggcgcccgccaccgcgcccggctaaatttttgtatttttagtagagatggggtttcaccctgttagccaggatggtctcgacctcctgacctcgtgatctgcccgcctcaccctcccaaagtgctgggatgccaggcgggagcccccgcgcccggctgcgtgttgaccttttaaagggtgaccactaatggactaaaaatcaaatgcagaagttgcaatccggcagaggaacaaaacaggaatgcaggccgggcgcggcagctcacacctgtaatcccagcactttgggaggctgaggcgggaggatcacctgaccaggagttcgagaccagtctgggcaacatggcgaaaccctgtctctaccaaaaatattaaaattagccaggtacggcggcttgtgcctgtagtcccagcgactggggagactgaagtgggaggaccacttgagcctgggaagttgaggctgcagtgagccaaggtcgcgccactgcactccagcctgggcgacagtcagactcctgtttcaaaagccaaaaagaaaataaaacaaacaaacaaaaacaacaggaatgcagaaacctaaacatttaatcttatcactaaaataacaggtagaacaggcttcccactcctctaaaacaccttagggtgcaagagctgtttcagggcgaggaaaccaaggctggagtgatgaaggggctcactccaggtactccgcacattctcccacctctaagtcgcagttgggttgaggacagggacaggtgggtgagggtatctgtgcctggagaagtgacatgtagtgttcctgacttgcagtcctgggcttgtctgagtggtaacaaagggcgtgaggtgcgcgcagggcaaaaggcaacaaggaggggcaaggcgagctcaacctctgaaagcatcaaggctggcagcagggcctcggtggccccggcagcagaagtgggcggcgggctggctgagttgggccctcgtgagctcagcacccagcggtatgggggacaggcccctggcctggatcctcttggagccctgggtctcacctgactctgagtagccagtggcagtgatgatggggacagccaccatgagcaggcccgaggcgctccacacatacttcatgaggaactgctccagcataacataccacaggcgttccagaaggatgaggttgatctgcgaggccaggtcctggtaggagcgctgtagcagggccagctccacctgcggggggtgacagacacagagaggcttcctggccatgcacaggggcagctcccgtgggggcgatggtcagggtctcccagtgccactcacacacgctgtgccatggtggccatcagaaggccgagagccagaggttacgattgggtggggccaggtctcaaactcaaggtgtaagggggtataagggactggctgatgtcacagtgcggctcccgtcccctctccactccctctctagtcaccttgtttctgtcctctgctgagcccatttctttgggctccctgccagccccctcctcctggctcggagagatcatccatcagctctaatttccccccctaaactaagcaaagagcagcgcaggacagcaaaaggcagtgctcttgggctgagtgcagtagctcacacctgcaatcccagcactttgagaggctgaggtgggaggattgcctgagcccaggagttggagaccagcctggccaacacggcgagatgctgtctctaccaaaaataattaaaaaaaaaaattagccaggtgtggtggcacacacctgtagtcccagctactcgggaggctgaggtgggaggatcgcgggagccctggagtttgaagctgcagtgatggcgccactgcaccccagcctgggcagcacagtgaaaccctgtctcttggttctgaaaaactcggttcaacagtctgggcctatttacgccctctttcccctcaactttcccacacttccttttggtgagaaatttgcatggcattttcccactgaaaccaggaggatgcgctcctgagctgggccctacaggactcgccccagtggatgtccccactgctgagcctggaccttgctccctcagcagtgggtaggcctcccctgtccttctgtcccccttcctgcactggccaccactatgtcaggacaccagcaggtggggaaagggacagccgcagggaagaggtggcagcagcagtcagacaggcgggggagatgggaggtgttgggaagtgctcccagcaaggtagccaaggggttgtgaatttctgggctcagtccaggggcacgcaccccagccttgcctccccacagccgtctgatgacagctgcctagcctgccactgtttgccaagtgctttcacgtctctgcatttgattctccccacatcccactgcatgtgtattcacgtgcccactgtacacagaacactgaagcccagggaggcaaagtgacctgcccaagcccatacagcctgatggtggcaaccagtgtgggaatttggaccacactggcagagctgccagaagaaccacattcttgtaaatgatgcttagacttatcaagagagctttactttgttctcaaacaagagatcgtgtgcatgtgcgtttcaataagcctcctcgcggcaatcccagaaaggacagaatactctgctatgtgccctccagccagtcagctgcttctgccctgatctgagcctaggccagtgtccacggggacatcagccagtgggactgccatgggccacatgctacccgagggtcctctcaccccacacagctttccagccgaggcctatgcagacaggccgtgaatgcacaccgggccctcctgccctggccaacaaaccctcttggccaacgtgctacttcctgaagctagcccttcaaagaaccagtaatctctctacttcctgaagctagcccggacgaaggccttcaaagaaccagtgatctctcttctgcccccgccacccaggtcggcctgcacagctgagctccctgcaagcccgatctcccattcctgaagcaagcaccctggcaatccagactcgtgctgggagctggcaggggtgccagccaaggctgacaatgtagctgcggggaatgtgccaagcgcctcgcccaaggctgcagctgcttgccaaggccctgcagcccagcatgcgggagaagaggagagggaagccagggtggtggctgaagtccaggggccttttctctgaatctgcagtctggcccacacccgggatgcccctctccgtggaattcggggacaagcctgcttctctgctggtgcacagccagtgagacaaggtcccagggcaagaggccacctgacccagggagcacacacaggccttcgggggatggatgccattgtgcccctcctcccaagaagcactggggaaccgaaactgagtcgcagagagcagggcccaaggcagctgcaaccccaggcacgaggaaggggaggggctgaggcgagataaagggagcattgacctggagtaacctttcccagcgcctgtctggcccgccggccccggcccaccagggagccaggagacagacagggttggaaggacagccacgccaggagcaggaagtgtgtcccgccgcagtggcggcctgggcccggcatctctggtctgggggcccgggaaggcagctgagccagttggtagccaggcaggcctgtgggctcaggcgggggtggccttgaccccaagtcccactgctgtgctgggcgctgctcattaacctccgcttgggctgagtcatgcccataatgccggcctgcctggccagccagctctgctggacgccggccttcaaagggcccaagggcccaggaggggctaggcagcaggctgcgtccctcggtccccgctcatgaatggcaggcgtctcctcctggctggctgcaggagtggggcgggcaggagctctcgaggctcaaaccgctaggatcgcagctctaaggccaggacaacctccttgaggaggagaggaagcagaagtggcctcgagcgtgcaggcaaccagcacaggacagtccccacccagccttcctgcctctccactgccgcgcctgagtccacggctgcccaaaggccctgcccaccccagcccggctctcccatggcctgcccacacctttggcatcagccccggcccgccccagactgtccccaccgctcacggctgcctgcccccgggcctccctgccacacgcttccctccgtgcccggcaccccaacctgccccacctcatggcccccatagaaggcgatctcctccgagttggccaccacacgcgagtgcatgtagcgcagctcccccttccgccgcgcctcctctgccaccagctccccgaacttgggcgagaaggcccgcagcacgttggccgtgaggaacaccacgaggccggcgatggccgagggccaggctgtgccggctccacgggagcgggccgcccgaagcagggtgtaggaagtcacagccacgtccaggagtggcttggtcaggttggagtagaggtgggccacagaggccgcaaaggccaccacgtcctccgtcagagactggtcagggttgcgaagccgcccgtccatgttgctgacccggtagtaggtctgctgggagaagtagaggcggtaggcgtgggccaccagacggctgcggaacgacagggccagttggccctccaggtaacggatggcactgttgacgaaggtagcagggagggcgatgaggagccactgcagcagctgccagccaaaagcccgcgggtccttgcggacgatgcagcgggccagccttccgtccaggcgggccacatacaccgacaggaaggtgcggctcaccaaggcggccgagtgcagggccagcagccccgtctcccggcacaggacccgggggaacagcagccgcaggagccacaggagccgctgcaggaatacccggttcatgccagctttggccgccgcgaccccggaggcctcctgcgtgggctccccggcgggcgcctgaagacccctggccggggccaggcactggcgcaccaaggggtagactttgtgggctccataggccgcgagggccaggagcacggccgtgcgcttcagcgtgttcccccgccagggccggggcctggagagcaccggcatgtcacctgggctggctgccgcgtagggactggggctggtgcctggggcagcagttgaggcaggtggctggaaggattgttgctctgaccctgggcctgttgtctaggcaactggaaaccttgcgatggcccctgagactgtcgctttaggcccccggggtggtgctggggcccctggtgcggtgggctcagggccctccagggtcgcggcctcttcgggcagcccaagtggaggaacttggctctcctgtcctgtcagtgccctggcccctgaggtcagggccttgagaggtctcgggcagagggggcgtctcttcctctccaccttctcctcctcctcctcccccggtggcgcccctccccggggcaccaggcgcgtccgtccgctccgcagcctggctgaagcgacagtgactcctccaccggcccagaatccccacccactcttccccaggggcgagtcgggggaaggggaggaggcggaggaggggcgaggggcggagtccgggcgcgggagccccaccctgttctcgcccctcggcggggcccgcccacacccccacctcccgttctcgcccctcggcggggcccctcccgcaccacagagacgtgggacggccgcgcggactagagaagcggccctcgccggcccgacaaagccccgccccgccccgcccgcgtgctcgctccaccccgccctgctcgcccggagcccgaggcgcctcttcctctcccgctcggagcgccggccctccgctccggggcggggtgggaagcggaggtgggcggagcctccggggcctcgcgagggctggtgggcggtgcccggcgggcgcttccggtttccggccgcggtatgaggggcggggccggggctgctgtgggagagttctgttgctgcggcggggcctgcacgttgactgtgggaaactcggtgagcgggctccgcgcgccgggctgggctccgggaccgcggaggctccccggcccatcgacgagggagagaggcgagcggcgcggggaggcccgggggccggggaatctcggggcccgcagcctacctgcgtgtgagaggcaggggcgaggggaaaccgggcggcgcctctagaagctggtctcgggggcggggcggggggcggtgaagccccacctggaggagcggccgggatgggcctccgggacggtgtgccaggccggggccaagtcggaggcccctcgctctgggtgggcgctggggcccgcgagggctactgtaaggacccctggcttctgaggatactgcgtctagaactttctccgtatggggccttgaggtgcttggtcgagacctgcctttgcgcttggtcccgaatcctgccctctaggagtcgctcttgcgggcctccagcccaccggaggcgaagcggccccgggcggaaggccgctggatcctcgagggaggtgccggtttctctccgcgggcgccgtggggacggtgggaggcgggggcgtcggcagcgcttggactaggtgcggccttgggcctgcctggtagcggggatttgggcccgcagagcgcccgcctctgcggctgagttctgcctggcggggaagggagcgcccgatgggtgccgaggcgtcctcctcttggtgccctggcactgctcttcccgaagaacgcctttcagttaaacgggcgtcggaaatctcgggcttcctggggcagggatcgtcgggagaggccgctctggacgtgttgacacacgtgctggagggggcaggtaattgaccagcgaacggaagtttgtggggcctgtgaacgctgctggccaagaggccctgccgagtggagccctgcttccgccagcgcatcagagactttgaagcaaagtgcagggggtcagggtggagagtggcggccccagcctcgcagggtaactgaactggatgttcttggctgcccagcgcttacaagtcccgtaccttttgtgccctgccaggaaacaagctcacatcttcctgtgggaaaccttctagcaacaggatgagtctgcagtggactgcagttgccaccttcctctatgcggaggtctttgttgtgttgcttctctgcattcccttcatttctcctaaaaggtatggcctatggagcaagcaggcgagttaggcaggagggtgcctgtgccctagccctgggactggtgtgtgcagctggtggaccctggaattgggacccgatggaacaggtagaacctgtctggggtgggggtggcaggggttgtgtttgttattgccaacccttcccagggttctgcttcgtcatgacttgctcagttccttttcctgtgtcccctgccttctggtcttcagaatgcccccgagaggcaggaagatctatgttacagttctggaaatgatgccctcccacccactcttggtccacggggtgctgggatggtagcgtgggattcggaagacttgcaccactgggtcacgttgttgctgatttggtgactcttgtcctcctaactagtctcactggtattgcgcagtggctgcatgaacattactcagcctgtggaggatgaagccatattcccttttaatgaacagaggacctgttaaaagtgaattggagattaattttaattatgtataatacctgaacacatccctatttaaattacgatattacaaataaggccaaatctccacaggtatttttaaaagccgttttttcgtgaaaaattatctttgatgtgataccatagaaagtatgcagtgctgtctgaggaggattcttgtagaaaaccacaccttcgtacagttgacaagacgtgcagagatagagggccccggggagctttaatctgggaagctttagaggacagacaatctgatttctacacaaaggaaactggaaaagcaaatgaaagagggagagggaagggggagcttccagaataagctggatttaagacgtttatctaccgaatgccaaatcggtaccttgttgggtccggattcaaacaaatatcattgccttcagtgattggcatattcaactctagccctgatgatgagggcttcttgttgatttgaacaatatgtaaacacttctgaagtctcttcttagagctgcatcccaaagcatttgtggatggaaatgatgtgaggtctggggtccatctcatcataacagggtcgggggatatagacaaaccaaggtttatcatgtggaaagacagtttaaagaaataacgtgtatggggcaaacatttgaatattacaaaggggagtacaatgaaaagtaagtttcccttttcagagactaccagtatgttttctttttgttgttgtggtttttttgtttgtttttgtttttattttgagacagagtcttgctctgtcacccaggctggagtgcagtggtgtggtgctcggctgacagcagcctccacctcccgggttcaagcaattctcctgcctcagcctcacgagtagctgggactacaggtgcctgccaacatgcccagctaatttttttttatatatatatttttagtagagatgggagttcaccatgttggccaggccggtcttgaacttctgacctcaggtgatctgcccatctcagcctcccaaagtgctgggtttacagacgtgagccagtgcgcccagccaactgcccacgtttaagattagttttccaggctgggcgcggtggcttacacctctgcactccagcctgggcaacagagcaagactctgtctcaaaaaaaaaaaaaaaagattagttttccagacattttgatctatacgtggaccagcatctttttttttttttttttttgagacaaggtctcgctctgtcacccaggctggagtgcagtggcgcgatctcggctcactgcaacttccgcctcccaggttcaagtgattctcctgcctcaccctcctgagtagctgggattacaggtgcccaccaccacgcctggctaattttcgtacttttagtagagacagggtttcgccatgttggccagtttggtcttgcactcctgacctcaagtgatccacccaccttggtctcccaaagtgctgagattacaggtgtgagccattgcacctggccttttttccaatagtcttgaatggatgtcaaattagagaattgcaagccactgaggctgactttgcatgggctattcggccattggagaagagtacaaagctggatttccattttgctcagggccctagagctcgtgtgtgtgctttctcttcaactcctgtcctttttgtcttcttcacagatggcagaagattttcaagtcccggctggtggagttgttagtgtcctatggcaacaccttctttgtggttctcattgtcatccttgtgctgttggtcatcggtgagtgagctatggctgagggcagctacctgacctagaccctggtctctgctgcaaaaccctttgccacttttgatgtgtagcatccagttttggctgctaggagacagaccaatgaaatgctgtgtctttctcttgagggagggaagaggctccctttgcccatgctgctgaccgctagtcggttcttcactttgaggcccctctaggccgtacatggtggctcatgcctgtaatcccagcactttgggaggctgaggtcggtggatcacctgagatgaggagttcgagatcagcctggccaacgtggtgaaaccccatctctacgaaaaatacaaaattagctgggcgtggtggcgggcacctgtaatcccagctacttgggagactgaggcaggagaattgcttgaacccacgaggcagaggttgcagtgagcctaaatcgcaccattgcactccagcctgggcaacaagagggagactccatctcaaaaaaaaaaaaaagaggcccctctagcagtgggcgtgggcttataccaagcagtttgtatgcagcttatgacggccaccttacattgctttttttcaagaccttggaaggagggacgcctaaggtttctgaggctgctcctcaggtcactctagaactgaagccaagagaagctaactggcctgtgaccttggtctgagtagtgctgctcaccagtcacttaaacagcagaattgcctggagcagggcctctaatgggggactgagcaaccaagcacacagtgaagtcctgccattccctgtagtagtaggaggagaacacagagatgtgtggcagcatatcttggggagagatcctagacctctctgcatctgggctagacttgaggttttcccaggtcgttccagctctgtagttctgtaaactctgacattgaggtgtacactagcaggtgcttgaaagataaactggtccaagggcaagcaggctctgggataaggccaggccaggtggtggtaagatgaaaggcagacattttgcaatgaggtggtagggtgaccatctggagacaagaatcaataaagctcttgtctgactggtagatgtttgttgttttgctgtggtaagtgatcgatatgtccccctgtttgggctccaaagtattggcttggctctgctgtggacaccactcttgtctcagagctgtggtgcctgcctaggcgtggaacactcctcccaccgagtcccagcagaaacactgagcgggtggggggctgtggttcaggggaatgtgcaaagcctcacccaccagcttcagcattaggcatttctccttcctgatgtctcagagcctgataggatatgttcaggctggactgcctctgaacaggccaagtgttacctgacagcttccaaccacatagggtaggtgccagctgcctgagcacctcagtgttcttgaaatacttggcaaggccccaagaggtagtagctctttctaaccagggttctcgccctgagcagcctccaagccaggagtaggtaggtaatatatgtgtcatccccaggccactgagtttttgaactgagcatgtgtgttttggcttttgggtctggggtgggggtaataactggggaggggagggaccatgctgaggatgattccctcagggtcttgccccttccccaaaccagaaggagtatgtttctttcctagagcagctgagtgggctggagagatcctttgcggaatccagtagttgacaaagccttcattcttttttgggatcggggaactgcttggaagttctagggggacatatggccatgatgactggctgcttcctactcccatgttaagaagcataatctagaaagatctgcagagccttcttcaaacagaagtgttagtcacaggtactagtgaagggtaaggggcataactagctagagctgtggccttgcttgggggtggggagggttgagcagatcctcctggaggatggagttgctgagggtgcaggatcttcccacctgggctgaggcccgagacagggagggctggtttctactgtgggacttgggttagtattgctcagtcccccatccccactattggtcattggccaaggtggtccttaggatggtggggttcctggatgcaggtgacagtgtaaggaaacatgtttatcttgtttttctgattacaaaaataatgggtaattattcttaaaaattcaaaagttgaatttagaaagttaaactccccataatcccatttcccacaggtaaccatcatgagtattttgttgtgcatttccagaggggttttgtatgctgacatctttaataaaatgtctacaacggtgggatcatacacacaaagtatttatgtttctttccacattcctgctgggacatggcaggaggagcattccacgcctgagctggtagcacagctctgagataagactgctgtccatagcagagcctagccaatactttggattgtgctttttctacctgctgcacgttagacatcttttttttttttttttttttttgagatggaatctcactttgttgcccagactgcagtgcagtggcgccatcttggctcactgcaacctccgcctcccaggttcaagcgatttcccctgcctcagcttccgagtagctgcaggttacaggcgcccgccaccatgcccggctaattttttgtatttttagtagagacgaggtttcaccgtgttggccaggctggtcttgaactcctggcctcaagtgatccgcccacctcggcctcccaaagtgctgaaattacaggcatgagccactgtgtccggccaacatctttttatagcaatctcattcttcttaaagatcatgtagtattctctcatgtggttgtgccgtaatccattctttataagcatcttcgaatcattgcaaatttatgcaaatacttctgtgggataatttcagaggtgaattgttgaacccgagggtatgaacattttgcattttatacaggtgtgctgtttttacccctgctaacagcgtttgagagtactcgcttcgtggtgctgagggatgggcagatttttataatgcaagatcaacataaaaactaagcagcctaaaaccggaaattaagaaccccatgaggccagtgccctgactcacgcctgtaatccccacactttgtgaggctgaggcagttgcttgcgctcaggagtttgaaactagcctgggcaacatggcgaaaccccgtctctaccaaaaatagaaaaagaaaaaattaactgagtgtggtagcacacacttgtggtcccagttactggggaggctgagaggtggaggttgcagtgagctgggatcgtgccactgcactcaagcctgggtgacagagtgagaccctgtaacccaccatacaaaaagaacctcgatacccatacagtgataccttgctcctctcatatgggagtctattaagagcattctttgggtacatcttagtgtattgacttaaaacgatgtctcaggatgcatggggaaaagcagtaggtttggcgtggctcaatttctacattagagacaaatataaatatatttttaactggagctctatatgtctaacagcggctctttcaggagcagaggctgctcactgactcagcaattatttcagtgcccactctgcacccagagctatcccaggccctgggaatatagtataaaagatttctgctcttatgaagtttgtagtctactttgggagagatggacccaaaaaatgtgtttaaagagaatttcagagatggatgtctattacgaagcaggtaacagtgtaatgtgactaaaaatgactttagatgtgaccacatttttattgtatatactgctagatgtgattatgttatgggatcctttccgtttctacattttgggtgtgtttgaactttcgatgagtgtgaattcctttcgtaatcagaataaaacattatagataataaaacccattgtaaagctttgaaatgaaacccttgactcctagctggtatcctgcaggtcttgactcctatttttttgtttgtttgcttgttttgttttggctttttcgagacagagtctcgctctgtcgcccaggctggaatgcagtggtgtgatcgtaactcacagcagccttgacctcttgggctcaagcgatcttcctgtctcagcctcccgagtagctgggactacaggtgtgcagcaccatgcccagctatttaaaattttttttttttttttttttttttttgttgagagagagtctccctgtgttgcccaggctggtcttgaactcgttggcctcaagcagtcttcctgccttggcctcccaaagtgttgggattacaggcgtgagccaccacatctggcctgggtcttgactcttaagcaccttaggtccccggagcaggcatttccatctccaggttcaacttatcattgtgggggttggggggctatgggccaacttgagatgaacagaacaagacgcggtgagggtaccatgggaaaaggaagccacccccatttccagaaactctttaggcttggttagcatcgtgaactgcagagcaagcctggggcctgtgtagaatggggccagggattgaaaagctggaggaaggagtgggtctgagggtgggagcttccttttttttttttttgagatggagtttcgctcttgtcccccggtctggagtgcagtggctcaatttcggctcactgcaacctccgcctcccgggttcaaatgattcttttgcctcagcctcccgagtagctgggattacaggcgcccaccaccacgccgggctaaattttttttttttgtatttttagtagagatggggttttgccatgttggccaggcttgtctcgaactcctgacctcaggtgatctgcccgcctctgcctcccaaagtgctgagattataggcgtgagccactgcacctggcctgagggtgggagcttctgataacagcatcccatgaggggtgtatgtgcatagaagtgggaagaactggggaggcggatttgagggaagtgagtctgacctgtctcatgccgcctgtctgcctggtatggccttatcttgccctagtgtccgctaaatgcccgtgtctcctctctgctccaccacagatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttgtgagtggggggttgagggggcaggtgctgtgaaaggagccatgggctagccatggacaccgagctcagtgggctcagtctcccccctgtgactttgattcctcctcagtctgtggcctggatcccaaagccctgtctgtgttagggaagccacatagttttctcctgacctccagaggcagcgtggagagtaggagagggctgcctgaaatatcagaagaccctcacacaccacatactctcaggcaaacagatgactatctcacggtctgtttgcatggagagtgagatgtaacggtaaggccttgccctcctctgggagaggaccttcagagtccagctcacaagggagcgactgaatgggggactctttgtgtccggggtgttgacctagggacagcaggtaaaagtggcacgaagaggctgggcctctcctcacctcagggccttccccacgtgaaactcgtaatgaggacatgttacattccatggcagccagagtatttctgatgatttttttggtaaaactaagtaccttaatcaaggctaagggtaactagtcgggcaaaactagaccactacgaagtgcctatttgagcctggggccctgtttgctgcctcctgcttcacatagccgttctgatcagcagggcctggctgggaggtggatgggagctcagaccatgtatgaaggcattggaaaggcgcttgctttgagggtggagctctcatcacttaatcacttctcaaaagaccccacctcttaatgctacggcagtgaggattaaattccaacacatgaagtttgaagggcactcagaccatagcaccaagtgattctcaggctcatggacagttattccccacttggttttgtgccccgagactcaagaatctccatgcctaggagattcttgctctctagtcacctggtgtgtcctgctttactaggcgctacgatgactacttgtcttaaaatctgttgtttagatgatctggtactctctgcgaccaagttggaaagaggggtggagctagaaaaggcaaacacatttttttcaagataatgggtttgatcacagatttgatctacaagcttgctgtcttcaaacttaggaaagtcaggaaggctgggaggagtcagacacataccctaaatttttcaggaagttccaaacaagtattatcttgtggtctgaggctgaaagggaagcagatctgaaagactgagtctcaaacccagaattctgagtgtgacagtcagcaaaatgaggaaaaaagaccacattgagagggaaagagaggaaactaggccatctaccagaaaagcatctagagctttaagaatggtatgggggaggggtgggctgggtgcggtgacttaggcctgtaatcccagcactttgggaggccgaggcaggtggatcacctgaggtcaggagttcgagaccagcctggccaacatggtgacacccagtctctactaacaatacaaaaaaattagctgggcttggtggtaggtgcctgtagtgccagctactcgggaggctgaggcaggagaattgcttgaacccgggaggcagaggttgcagtgagccgagatcacaccactgcactccagcctgggtgacatctcaaaaaaaaaaaaaaaaaaaaaaaagaatagtatcgggaaggtgaaaacctgccgggagctctgaatcatgaaagacatggagaagtgaggagaaggcagtcccttttatatgtctgtgtaaggaaggagatggagggtaggtggtcaagggcaaaggaaacactaggatgagaaaatggaaattacaggtgggcaagagtggcatccctaaaggatgtacttgatgagattatgtccagaagctgttgagatcatctgcagaaggcattgccaccgatgcttgaggatttgcagagtgggagagatactggcagactgcagcctggcaaacatcccaatttccaaagggaggagaaggtagatgaggaattgacctggggagggttgactttgatctccagccatgctctagaaagaatagcttgtatgcttttggaaaagaagagcgggatcattggtgactgctgtgaattcctggagaagttctgtcagccttctatagatggagtgtagatggatttttagcatgatgcttgccagtctgagtctgttcttaacgaccagatgccgaagtgtggggaaggtgctggcagaacagtgtagttaggtgtggtcctaacccacatgagtggctgccatgtggattggctctatccacacatacacatagaagccttagggggctcactctttttttttgagacagagtctcactctgtcgcccaggcaggagtgcagtggctcgatctcggctcactgcaagctctgtctcccgggttcacgccattctcctgtctcagcctcccaagtagctgggactacaggcgcccgccaccatgccctgctaattttttgtatttttagtagagacggggtttcaccatgttggccaggctggtctcaaactcctgagctcaggtgatctgcctgcctcagcctcccaaagtgctgggatcacaggcgtgagccaccgcgcctggcctgctttgttttttcagtgtttcctgcaagctgcaaatgggctgtgtggccataaggctggacaagagcatcacacagaaagccaaggtcctctagggtcacagccaccatcttagatttaactcttagactagcaaggagtatatatttctggcaaaattccagaaatgattaactagatcgcttatgggcaactggtgaatccacactgatctctgggatcaccgtttccttttctaagaagtcacgcaagaccaacctcatggcttttttggatcaggctactggatgggaacacgggagagtgcggcagctgagccaccacgcccagcctccacatgctttttaaaaacattcccgtgtttaaaaaaagttaaccacggggcttttaagcaccacatgctttaaatgccccttggtgacttgagtgttctactcagtttatcatgaatgtttttctgggacaactgacctgtttccagcatatttatttatttatttatttatttatttattttttttgagacaaggtctcgctccatcacccaggctggagtgcattggtgtgatcatggctcactgcagccccgcccttttgcctcagcctcccgagtagctgggactataggcatgtgccaccacgtgctgctaattttttaattttttgtagagacagagtcttgctctgttgcccaagctgatctcaaactgctgggctcaagaaatcctcccacctcatcctcccaaagtgctaggattacaggcatgagccactgtgcctggcctctccagcgttcttgagtgttcttgagtgtctacccaattcctcattggtggatgtcgagcctgcagctctgtttctgatgtcataaacagtggcctcagctagtcagctttctttgggcctcctgatcctcttggagcacccatgccactcctattatctgtctctttcttttttgttgctgttgatttttttctttttctttttctttctttctttcttttttttttttttttgagacagagtctctctgtgtcgctgaggccggagtgcagtggcacagtcttggcttactgcagcctcctcctcctgggttcaagcagttctcatgcctcagcctcccaagtagctgggactacaggcacatgccaccacgcctggctaatttttgtatttttagtagagacggttttgccctgttggccaggctggtcgtctctgactcctggcctcatgtgatctgcccacctcggcctcccaaagtgctgggaatacaggcatgagccaccacacccacctctctttctttccatgttctttatgtcccactgagaggctcagttcttgaacgcgagcaggtactcatggcgcgagcaggtactcatggcccgagcaggttagatggttaggagttaagggttccagacttcgtatgcaacttttctgcgtggtagagagcctgcctagtgggtattccagtactgctggcatgcagtcacctgtgtggattaacattttgcaagggtgtatgggttggagtggagcaggagagcctgaagtggggagaccaagttggaggttgtcagtgagacttgctgggaacctgaacgggggcagtggtacagtggtagtagaagtggggtggaggggacagagctgagaggcccaggtggagttgaatcagcaggcttttccagtctctgggagtctgagatgatcttggttctgctgtggacttgcggaatcgaggacgcagccccctgctggaaagggagctctggctgcccatggagtaacactatcgtgctaggtgtgagggctggttgcagagtgggacttctggccaggcctgggggcagcaaggaaaggaggggacagggagagcagggttgagcaggggaggcctggcagatgagcaggatagggtgcttccgggcagtcgagcttgggttgctggcttcagaggcattgaggccagggcaaagggaatgtgctggcaggatggattccagcctccagcagagcgatagaagatcggggagcagaaggaagagggaagcaagatcaagaaggaggatgtgagcaggttagtggccaaggaggggagcacattctggagaaggcctggtgcttggcactagttttcagcgggactgggctcagaacacataggaggttagcctgagagctcccgagtagcctttgtaattgggaaagggggcctggcctgaaaggaaacatcacacctagaagcaagtctgtacccttggccccccatagtctgctgctgctgcctgggatagcagtgggagagtcccagcttcccagccaaagccttctgagcttttgtcctgcctctgccactactgtctcagtcctgtcacttgacccagaagcctggggctgctctgccctttcttcttgtcccatgtgactgcccaaccatcgtggccatttctcagtgtgtggcccagcagggtgaggcgctttcacggtgtcaagtagccaacctccagaagtcttcagcctgcagagctggactccacccatgaaacagcctgtagatgtcacctcctaagcctctctctcacaacccttgggaccactgctgtggtggggccaccaccatcccgtatagaccaagcgggctccctgccacctgccttcccccctttggcctgtgcaccccacttccagtggctcgctatcacatggatcctccaggacgcggctcccccacagtctctgcttcggcctccccctgtcatgaagcagtcatgtgggtctcatgggagagcctcacgtaacacatgctctcccccaactcgattctctgagcattttggggacctctgtgcggaacaccccctccagctgccggcccagccggcacctcctcttcgtgaatctccgaggcttccctgtggagcctgttccgaggggcccacaccatgttcccggctgacccatagcgctgtcctcgggtcccagggcagcctgcacacgcagctctgaggtgtggcacttggcagggttgcccatcgtggaaaacctgggctcttccccttcagactgttcagctcagtgccaagggcctggcacatatgaagggcgctgaaacatttggtgactgaatgggctgtcccgggctgacggcgacagctttaggtgcgtgcctgggttgaacttgttgggctttttagccaagaagcccagcttttcaggtcttaggagctatgacagtttgtgaaggcgggtccatcggggccacctccaggggaccacactggatgagccactggtttccacttgtggaagactccggcagtcgctcctgttcccttcctgccaaccttgcacttcgggggcacagctagcgagaggccctcttgagtcttggagtgtgttggggacggcagctccctctgggctggggtttgtgtgttcagaggacctgcactgccttctctgccttactcagcttaaatgacggtcaaggttaggcccaaagtgctggttagcagccagtcgcaggaaggcccctgtttgtgtggaagccccctgaatttttgctgacctgaacttgatccacaggcatcttttgtttcctctttacccctccagggtagaatcccatcgctgccattagcccagatggagctgcccgtgcttctctgctgagctgctttttcttcttttttaggttgagtcatctaatcacagactacctttgcctaagttgtcttacctcagtcggttgctctctaccctccagcttaccccaaacccctcagatagctggttttaaaaaagatacacagcaaaaccccagaaacccagctggtctgtgtcacttgttctcaagaagaagggaggacaggccagacccacacctgcccctttgccctgcgcttagtgcactgtcctcaggatgggtgagctccatctgggtcgtgggctggagctgccacaagtcatgttctcatttgaaacggcctccatttcccccagctctagccctcctcttcccgtcttctccagcgtctgtgtgctgggaggctacagggaaggccacgcagctgtaccaaaatggacttggggcagccctttggggcagccttctcgggtctgctctaggtgactctcccagttgtaacctgttttcctgattccagactggtgggtaagagtcgctgagggcagtggaagccctggtgttagtcattcttcttcactgaagccttcctgaggcgtcacctgacttgcttccttgcctgggcgctgcctcattttttttcttccacagctggggcgtgttcacccagagtccactggccaccctgcggtaggcctggaaagtcagcaggtggcgctgggacaccggctttctgccggctgggggctgaggagtgagcttatgtgaacaccatgtgtatgcaggggctgggggttgaatgacttgactcgcctgaaacccgtcagcagggcgggccgggggtggccacagcatggaatcttttggtcgggacttgctccttctccatttcctattaagcccgtgtcctcttccccttgctcatgggggaagacagggctgctgaaaagtgcttatgagccatggctctctccatttgatatggttggccctgtttctctagtctgtggagaggttctgtttctcctgccttctctggtttactcaaccttttataaaagcacgatagccctgctcagtgtccaacaacattctatcaagaaagcccagtcagattgaggcattggggctgccatgtgtcttccaaggccacatctggattctgttaagtttcgttcactggcctttttttggaccccaggccattctattggtgaccaccctgtatctgtaggagttgcctttggctcttaggttctttcctgttttctggaaatgaatagctaagaacagtgattcgggtaagactacttgggagatccagcagaggcagaagctaaaggccatgttcgtgccctgtcctgggggcctgggaagctacaagggaacagacaagcgcacgttaacgtgcctgagtgacccagtgtgagggagcgggaaaatgttctagaaggctggctcccaggctgaaaaatgccagtgatcagagaggacctggtctgcattgcttgggccctgggtgggggttgagggtgtgaggatgcagaggctggagctctgggttgtgccttcaggtcgcggcagtgaatgttttttccccctgcagccatgagcctggcttgcccatcagaacgggtctgagacggcgccttcccactcctgtcttctgtctcctctgttgctagactgagcagctctgtgtctgcctctgcccctcttggtgccaggctcccaggtgaacacaggtgcagtctaggcccagggagattctgtccagccttacgtgcagcctcaaatctgtcccctcacctgtcagggagcatttcctctcctgggagtgggatccagtcatctggaagcccagccccgcgccctccccccctttttttttttagctatacttgctggagtgggcggaagaccccttttcagtgtgccaggtatgggagtgcagagatgaaggcacagtgcccagcctaaagaccttcatagcctggtagggcagccatataaacggatggcagccacgcagagaacagagaatgaggtagttacatgcgggtgcctggggggctgctgcaggagcccccagaaggcgtccctctgatggggtgggagatccaaaagggtttctggggggaggtgaggattgagctgggtcgagaggacattccggcctggagaactgccacacagagccaggcgtgttccaggaatggtgaggggttaggtgttactagagcagggggccacgtggttagtgaaggaggagagctcactgagggcatgcgtgctggcagcaggtggcttaagcagagggctgacatggtcggatttgccttgctctgggaggtggatgggaaagccgtatggcagcagatagggaggaggcgccagcagtggggatgatggtgggcatgtttgcagttgacatggaaagtgctgggttgtggcttgggctgggggccaagagggctgagtccaaggcggtttgcctgcccaccactacagcaggggctacacgaggtggtcaggtcaggcaggacaagggaaggcccgttttggacaagctgagtctagaatgtctctggggacatccaggagccaatgtttagcaggaggttaggtatgagtctgggccacagagaaaaccctttcggggataagagtggctgggaggaaggtatagggtgtcagctgaagagtgcagaccccagagggagcagaataacagtgggaggagggtgttgcgaggggacctcaggagggtaacttagcagcagagcaaggagttcagggtgacctccggcctgggcggttaggaggccactggtggccctgctgctggcttggaagggcaggccttggccagcctaggttgaggaatatatgggagggaaaagaccaggggcttgggcagggtgactccaggaaggaggcagttgaaggtgaggttcctggggggagaatgatcccgggtcatccagcaggaagagagaggacctagaaggtgtgaaaaagaactatcgggctgggggtgcagtgggaggagtatgcccggggtgctgtgggggtggggagcgcctgtgagggttggcaagaggaaggggaaccggggcctggcagaggggagccccagactgtctcaaggctgggaactgaaggcctgggctggggctgagcagggccaggctttcggacacacacagcgtggatcttgcgctggactttgtgtatgccctggcctatcttggaagccctggttctcaatagccgggaagggcctgggacggtccgaaaagagctgggcctctgctgcactgccgcggaagcatttgtgttagctatctccctgggtactggggtgacagccatgggcactcaccagcagccgcttgcctggcctggtggcggggagtatagccttcagtcttgcttggtcctctctctaccaccaggtggcatgacccccacccctcaattccagctgggaggagcggtcctcttcctctttctacatcactgggatccgctctggggctgggcagctccttgccgggggcctgggtcttagtcagacttgcctttctttctaggcctctccattgacttctggccatgccgatgtgagtcagatgcattgtttctctctggctcctagggcgctcagtagcttcctccaccttcaggctgtagcccagtgcggggcaggctggtgggcagctgggggctgaggcagggaaacctgagccctaggccacgaggtcctgggccgctaattttagaaagcacatgtcactggaaactctccttctctgccaggaatcaacggcctggctctcctggtgctgccaggggcccctgggagcctctccccaaaccaggaacctcaggggtgtctcctggcccgggtgggtactttctgtcctgagtacatctggaaaggggctctgccgaggccctggagagccatggcttgggccagggaggtagctcaccttgtctgctctttactttctccagcccttccgggctgcccctggccatgagcagaggctgtgaagtgtgaaggcctggctggggcaggaggccacttcgactcttctgagtaagctgttgttgaagcactctggactaagcagatttgtctcttccttcccccaggccctgtgtgacccttgccttctgaggtgtgtgagaaaggaacccctgccttgttttgactgtttgaacgagtccttccctcctctcttcctgccagctaacatctcggggcaagggtgaaccaagggaaatgaagtggccattccaatctctgtttggggactagcatctgcctccagctgccacctgtttgcctgtctctcctggctgcttcagagaggcagcctgcgcctgtgtcctgattcctctacaccctccagcccaagaagacctcattcggggtgctgttacataacggatgtgttccagcgcagcctgcatgatgggttgggaaggaggctggccagagaagagagttctatcttacgttgggacctgggagctgttccctgttagtttagagagcagagtggttccgagctcaggttctggagtcaggcagacataatttggaattccagccatgtccatttctggtttttggccttgggtacattgatttacgctgctgaacttcagtttcctcttctataagctggggcagtgatagtaacttcctcatcaggtagatgtgaggatgcggcctggcatgttggaagtgcttggattgattagcttctctcgttaccttaccaaggcaagcccagcctcgcagggaggaaggtggtgctgtggcttgtctggcacgtctaggccccgacccggaaagtgccgcgttctgggacctcatgctgtagcgaggctcttcccagccccccaggctcctgcttccagcccctctgagagctgagggtggccgttgggcacagcggcagaggacggctcctgggccccaccttttccctcacgctgccagcaccaggttggcggcttctcactcggctgccttggcaagagggcaggtccaggctggagctaggtgtggagtgggagcaaccaggaggtgctcctgccagcccttcatgctctttttctcacttctcccttctttttgtaaataattgcagcctgcttagacgcctggtgactctcatttcgcagcaggccacgctgctggcctccaatgaagcctttaaaaagcaggcggagagtgctagtgaggcggccaagaagtacatggaggagaatgaccagctcaagaaggtgagcccagcttcccgacccaccatggggcgtcctggtgttacactgtgggagccacattcttcagggcctcagtggccactgctagcctgtcacgctgggaaatgtgcctgaaaagccagagttgggtggaggcgcagaggggaagtcctcagtggggagagtatgcctgctggaggcgtctgtgtgtgagggtccgggtgaggaggagggtgttgctgctctcgtttccatccactgcttccagttagacccttccctgagaaaaatggcccctcagtgagccaggccctctgctgtgatccgaaggccctcagctaggcccttgttccctgcaagattgccgcaccccctctggaactcggggtctgtggcatccctcagtgctggagaggaggtgggggcagggtagttggccagtcttagacgtcccgtcaggaggtgagctgcaaggcaagctcggagggatgtggatgcagaggtgggatagagctggccaggccgactgggggctcctaactgcagtgagcggcaccatgtagggagcacgaggcaccgccatctgtggaggggttggtgagcaccatggagctgctgagccctgctgcttgggaaggaggcagggccaggggccaggggccaggggccagggcaggcaaggcgtgcccggcgagctgcagcaggtggccccgctggcgcttctctttccctcggcgggcagccacgccctggcctttgcctaggagctgggagcaagtggtggctcggttccgcgttgacatttccgaaggggcgtgtggccagggcagcttgaggaaccgcagctcggtggggaggatggggctggaacctctccctccctccctcctgagtaaccctggcctttggcacttttcccagggagctgctgttgacggaggcaagttggatgtcgggaatgctgaggtgaagttggaggaagagaacaggagcctgaaggctgacctgcagaagctaaaggacgagctggccagcactaagcaaagtgaggctcgacctcgtgtccttccccgcagggaagtccagaggagcctcctctgcccgctgctgcccattttgtgccaaagtattagtaacaagccttgcacgcacgctcgagggctggctgaaaacagaccaatagcaccctgcgcctccaaccccaatgcagccatgcttagccggcaggccagtgaggctaagtggtttgaatggggctcaggaggaaccaggctgcagttggtgggcctcgattgccctgcactagagcagtgcatgctggggctttcccgtccagagtgtggcacggtagccccagcatgcctgggggctgagaatgaggggagtgtgggagtggcgttcaggaggggagtgggcggctcccaagcggcctgcctgtctttggtctcccacgcatagacttaagtctggggcgttttcccccaataccacaggcctcgcctgctgctgctgtgtgcaaggcgtggttgtcattgggtctcgcttgcaggctgggatcttgctccctgtctcccactctcagcctccctggaggttacccttgccgagagccactagagttcctctccattaaagggactgggggatggcctctgtgtttcttttgctttatcttgagcttttttgtcagccctttccctctactttgggggcctgcaaaagcagaggggctttattttgagaagtagcctcctgtataacctcgtttgagatagatttgggccagtttctggtgtctgtagcagtcgggttttttccccctaattcctgtcttttcgtttctgttttcttggtcatttacatcatttcaagaactagagaaagctgaaaaccaggttctggccatgcggaagcagtctgagggcctcaccaaggagtacgaccgcttgctggaggagcacgcaaagctgcaggtcagccctcccgtattgctgcgcccagggcaggagagcagagcaggatgaggcagcccctgcgggtgcggagggaaccttccaggggcccaggggctggctgccctctccaccactccccctggccacctctgccctactgagtgggacccttcaccgggcaggaggggggtggcctggcagcagatgtaggcacttgccaaggcggccctcaggagtggcactggctcactaggctctgagccttcctaccttcgtgctcaggcgcagccatggtttggggcctggtcaagaacaaagaagcaggtgaaactctgggacccactgctggccttctttcctagggtgctggggagtgacgtagggcaaagatccctgggcaagtgagggcacaaggtgtcaaaaaggcaccttccctagcaggcgctagttgtggccatcacctgctgccctaggcctgatctgagtcctcagactagcttgggtgcaccaggccgcatctggaagcccaggcggtcttgacgttgggagtgagggccacataaatactcctaactttggacagctggcctcagtgcttggtggcccaagtttgggcaccacagcaggtggggaggaagggtccagcctcaaagggggcacccatgccctctgtatggggcaggcttggcagatgggcttcgagggcacctgtcaaaggtgtgcagagttgggaagggtctgatcaggtcttgaaggggactggatgccttgctgttccctgcagccaggactcagcccccagtgaggtcctggcagtcctccctggctggcgttaggtccagggctttccctagagcgtgggccagggctgacgctcccaccctggcaggcctttgggtgcagctggggagggggccccttgttcacttgaatagctgttgttaggagagaggggaaccgaggtggacctctggggcatggggctggaggtggcaggggaggagtggacccggccaacctactgctgtgggatttctgtccctttccaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgtacgtggtgcggtgtgtgactgcagctgtggggagggctctgctttctctcctgcctggagcccccaagcggccacagcccttcaacctgtttcccccactgaaggccaggctcacacctgttctcgaaggccttgccctctctgtcctcctgctccccgggctgggccaggcctcgcttcagggccacccgccgagtgtgtgtcctgtctgcctccctgggtgtgggcagcttgggaggctcagtaaaccggcggggcttccgggtagaggactcgcttgccttctctgggttcctgttcgtcacatttgggacagacagaacgtggcagaacgccactagtcactccctgcccccccccccgaaggtttgcaggatgacctctgactaatgccagctgggagaggagacttgtccttggcagtgacctggagctggcccagggcagagctaggcagaaaggggctgggaatgggctggggcccttggccctgagaacgtgctgggtgtgtgcctgccaccagagcgctgtgctggctccagggtgtccctcccgtggctccctcagagctgtgtcttccaggcccacagcaagccaggccagtaccggggcttcctgcctggcaccagtgcccaggcccctgcactgtgctactctccagtagcacatgaggaaggcagcccccgcccgcagcacagtgcttccaccctgcagggcctctgccatgcctggtgtctgcatgaggactgggcggaagggtcaggggagcaggttagaggtgtgtctcctggaactggggggacccctgaaggatgttgatgctggcagggtagctgacggcctgctgtgcatgctcgcttctgcctgccctgtccgggcccaggccagtggttcccttctctagcatcctgtcgcccttcccttgtgctcagagcacagccgcctcatgacgagttctgtccctttccaggcggtctgagaggtggtgtctgagggagtaggggacacgtgggcgataccctctggttgctgtgccaaggccgaaggctgatcccacttttccaggaagtgctctcagctaccttggacctccctgagctcacccttctctgagctttgaaaggctaaagtccaaacgggtgcttccctcaccagccctgatggcttcttccgctgttctgcctaggccagcagcagacagaaagctgcacgaggccagcttctggagcgccctttctagtggagtgatggaacaacaacggggcagggggtgtgggcacaggctcttagagatgaaaattgaggtgcttgcccagcctagactggagggcggcctgcaggctcgcgccttcctggatcagcttctgttccagggcatctgcacccgtgggcgtcctgatctgttttcttacccatcttccactagactgcgagctgcttgagggcaaagcctgctgcttgttgatctctgtgtcctaacccctgatgcaggagctaagtcctgaggaaatggtgtctctatttcaggaccctctttaagtgacaggcctctgtgaagtttccttttttcaatgtcttttttctgtgtgtttagtgtcatcgtggtgcatgaggtggcttggagggcatttggcctggaggtgcggagaacaattagcagagggtgattgtcatccaggcagagacttggctgacagtgtataaagcagttggcctgagctcaggggtcctgagggtgactgtgggctgcaggacagttggagtcggttggggacaggggctgtgtgagggcctggggcaccctggggagaggtcttgctgatgttgggaagcacctttgcagctaaggagggccaggccggagatgtgggagctgccagcaggcggggttcttgaaggcgcaggcatggtgagaggacaggcttctcagggagaaaaagaaaactggaaacagcggttgctgaagagatgggggccagggactgcaggacaggctccagagcccctggctgagctagggtgggactgcactgccactcctttctctgctccctgtctggtccgtgtatttctcacccaggctcttggttggccgtattccaagccaggtccctcccctggctccagaagtttaggggtaaagcccctccatagggggtgctgcctgctgaggagcagggcctctgggggttctcccatagcacgatagcagtcctgggcaggacgcaaagggagcagcccaagctgtcactttgctctgaggggtcacctgctcccccttcacaggctccaatctctgatgctctctgtgcttgcctgagccgcccactgcattgcctgctgtgccctgccatggtgcccagccctttgagggtggggtgccacatgctcatcttgtgcacggggtcccgcccgttgaaggacctgtctgtactcagtgtctccaattcctctccacctcttctcatggtaaaacgcatatatatcatacatatatatagtgtcatcagtgtatatgtaatgagccattttcaccatcgttaaatgtgcaattcagtggcattaagtgcagtcacagtgttgcgcagccaccacttccatccacctctagaatttattttctcaaactgacactctgtccccactcaacactccccaccctgtccccagcccctggcacccacccttgccctctgtctctgtggatctccctcctctcatgtaaggccctgtctctctcacaggagcagaaccctatagcaagtatccctttatgatggctcatttcacagaaatgccctccagggtcagccatgttgtgtcgtgtgttggaatgccttccctttccaggctggctcatatttccttgtctgggtgaactacgttgttgtctctcccttcgtctgcagatgacactgcgctgccgccactccttttctcagtcgcacaccacccagcctttcacacgcacccgctcatgcaagccaccctcgccaggcccccgtgacccttgccagactcagtgagcatttgcaggtcactgtccttcaccagcagcagcactggacagatggagccagccactgctcctccctgacctgtgaggggtcctcactggctcaggttgcaggaccccaccaggaactctcaggcgtcctcccctatcactgccacgtcttcgctctgcccctctcattgtgttccggggcttgcggcgtccctgtgagctcactcaggctcagggctttcagtgtcatctctatgtggtaagaacttgcacagttccatctccagtactttctggaactcctgtgtccacctgccaactagacatctccacttggatgacacttcctgcatgacacacccaaggctgactccagaccattctctccttgcctccccattgcaggacctggcagctccatctttcctcttgctcaggccaaatctgttgtccttaactcctctttgagccctgcatcctggtcatgcacaacccctattggctccaccttcaaaattgatccctgatgcagagttatcccctctgctgctaccagcctggcccaagtgacacaaggcacctgttcagtgacaaattcttggggtaacattttgaaaatttcagcacccatggctttacgcccacccttccccgcgggtgtggctgctctccagctcactctcgtcctgctctccccaactgcctcggctccagggggacaaggccttcccctgggctgctgccttccctgcccccttcccagtccccagaagggtgccggccgcagaggcctccagagcagagccttgctcacggcagcagctccagctggaggaggttccccctgcctcctgtaccccgaccccttccttagagcagcagaggcggaagcaggagcctgctttggaaaatgacatgtttttattgctatgtctgcagtggctttttagcacagtagaatgtccccgcaggcccgccaccctcacccagccccagccctgcagcctctgtctgggtgtcggggaagcctttcttggggtcactcagccgtctcgggactggacgtgacagacaaacgtgggttaaagctgctacacagaagactggaggtgcgggaagtgcatccaccttaagcctggacgtgggagccgtgtccagggtcccttcctgggggtgtgccccgcacagggtgggaagcctgagcaggccaggttagcagcccagacacccaggacggaatattgcagcctcttgccccacagacttgtggcaaagggacagcgtggggacagccccgaggcccccaccatgcacttttccaatccagtctggggctggggaccacacacgcacatccacacaacagactcacacacgcaacagctcgaagcttttgttttgcctatgaaagttagatctataaattcacactccttggctaggggcagaggggtaaggtagggctcacagggatgggagtggtaaggagaggatggtttgggctccttcctctttttagaaatatacaagcagaaatctcattctctcaagtttttataaaatgtgcaaaatacaagcctcctttgcccagaggcgccatttacatctggcattcacctttgctaagagatagagatctatatatactctccgtactcacgcacgcgtgcactcgcacccaagctcacacaattgatactggtggcgattggcgcaggaaccagaaggttccattgctggctggctctctaagcttctataacagggatggggagaggggtatagcccagctgaaatatttgccttggttctgctgcccctcccctgcctcccttctcctctctctcctccctcccgtctctccctccttcccttcctcacatttcccaagctgccactgctgcttctggggtgaggggtcacccacgggtgtgctgcagagcagagcctggagaggtgggcagggggtgggcgtggcaggggcaggaggagtgcagcactgtgggtgggggtggggcactaggcggggcctaggaccagctcggctagggctggagggggagaggcatctatttttggtgggttgtgatatttttggcgttttattaaaaatggaaaaagttgttttagtgagcactcatggtgctttctcccctcctcccccaggcagaccccaaaagtgtcagggaaaggcaggccccctggaggggtgcggtggggctgaagcaggggctgctatggctaccagaggtgagctggtgatgtgagctgagttgtcacatgacactctccaccacgacgaccttgctgctctcggacactggggtcagggtggtcaggcccctgacatctgcgtcctgagctcggtactccaagtggtggaggccccagatgggctgggtcaggtgctgccagcgctgcaggagaggaggacatgctgaagcccccagggtcacctgctcgtccccacggtgacttcctctgcctctctccggttcccactgcctgccaccctagtcggggccactccctggctaggaagcaggctgggttgaatgttcacagcaggggaggggagggcgggccgggcgggagccttacctcagccatggtgcccttggccctgaggaggcagcccaggaggtgcagcggcacgcacagcatggaggacagggcgaaggcccagcccatggcctcaccccaccacgggtacacgtaggtgttgttgtagaccagcggctcgtagtacacaacgttgaagatgaagatgccctacggaccagaatgctgcggttaatggggcccctaccccgccctgcctcgccccccgccctgccccacctcccccagcccttaccatgcagaccagcggggtgaagaaggaccagcaccatttcatccaggggcaaggtcggtacccgatcatacaggcaatgtcgtccatgaagcggtcagctcctgcggcgaggtgaggcgggagggccaagctggagacctgccttccccgccaccatcccccagcccagccctcagccatgacctaccgtacacccaggccaccaccacgcactcccaaaaggcctgccagagcagggtggtgccgctggccgagtagtagtcaaacagctggaagacgtacatcccgccctgggggacagagcccagtcagggaggatggcagacggccaccagaggtcacaggcagaccccccaccccactcacatcagtcaccatggagagatcgatgacaaagcagagggcacaacagagggccacagagatctccctttggaaacggaagtagtaggaggccgggaggaggtcgaggaggccggtgatgaagccctccacacctacaaactgtggccagggcagctcaggccgagccccgcaccgccctccacccctttccttgcctgcagccctccctccgcccccctcctggctccctgtcccagagccccatgcaaacctggctgtcgagaccaagcagcaacagcatgaagaagaacagggcagcccagagtggggccactggcatcagcgtgacagcccgcgggtaggcgatgaaggccaggcccggccctgtgggaaaggtgcaggctctagaccttgtagccgatgtcctgccctgtgcgcaccctgagccctgcctgcaacactcgcgcccatgcccacgcctgcctcagaggcgctgtcaaccctgggtcgtgcggcaggggctgggaggtcctttctctgtcaacattgacaaatcccaggacctgcccccacaggcccacaatctgacaagttccgtttgaatcctcgtcacttttcagcatttctattgcatgttcctgtacatcatgcatctgggtagcactcgctgctctggaggcggggctgggggtagggccctacctgactctgccaccttggagatgtgcacgccctgctctgcagccatgaagcccaggatggagaagaccacgaagccagcaaagaagctggtcccactgttgatgagagccaggatgatggcgtccctgaggggtggaggggccagagtggatgggttaggctgctgggcagggcggggcagggcaggacagggcacgggtggcagggcggcggtgcttacttgtagcagttgttgttgaagcggttgtagctgcccagggctgtgagggcccccaggccaatggcgtaagaaaagaaaatctgggtccccgcatctatccacacctagagaagggccggagagcgcaggcatgaggggcctgcagggctcccccgcagcgccctgctgcagcctctccacctccacctcacctgaggggaccccagctttgaccagtcaggcttgagatagtaaatgatgccatccagggcgccaggcagcagcactccacgcaccagcagcacgaccaggaccacgtaggggaatgtagcagtgaagtacacgatctggggggccaggctgctcagcggaggctgtggcaccacctccctcacacccccactcccagcgcctccggtcccccttgcgggcaggtatgttcagaggtccccattgtcctccgagccatggctcccgccagaggaagctaggggcaaggctgcgccccggcagccctggccaagtgcagtggggaagctccctgggcgcctcgtttgtctgcagggacgcgtgtcggtggggagcaggcgagcctctgggagctctcctcagtggggacaggaggcgtggagcacgtggggagtgagagctgtatgagtgtgtgggcagtgcaggtgtgggaggcccaggcagggagcgggatattggatccgggtcgggtccccctcctcttctggagagaggtgggggttgagcaggtggagagtggaactgggccaggcagaggcaggcgagatgcagctgccacactgtctgccccctcttcccacatgctgctctggggaccttgtcccccagggagctggccatgtcccacagctctagacactgtcttctttgttcaggtgactccccagcctgaccaggagcccccaagggatgtggccagactctgctctgggtccccaaggcaagataggtaacagatggccagaccaggtccaccagactgtcacaagagtcagagactggcaggagggcaccagtgggggtgatgggcacagggaagggacagtgcctgccagggcctctatccccaggagcaaaggctgctgggccctggatttgcagggtggggagcattgcttggctttcagtacctcccccttccttagggctagactctgtctggtcacctcccgttgccacaggtgtgcctggcacagacatccggctcccagggctgagccaccctccccgctgcatgcctctagtggtacctttcccgtggatttgacccccttccagacacagaagtagaccagcacccagcaggccagcagacaaagggtcacctcccagttgagggcccctggcacctccagtcccccagacagcctcaagactttgttcctaggggagggagggaggtcccatgaggcctgtgccagcagaggatggagccacagggtccacccccaggagttgtggctcccttctctcccacagcccagggttcagcgggtccctcttgtccaattgggctgggcctggagcccacgatcccctggccattgggaggccactcccatcccacctcacatgcagccccagctcccccatcaggggggagtgaccaggacagtgatcggctgccgaacccaggagcgaggctggccccaggactctccgaggacaggcaagggcaggcagggtccaggatggactgccaggcaacaccctggtgccccctcagggccactcccctggagccgggcaacatgagggagacctgggggatgggatgggcttggcccagaggtgccggactcactcccagaactcgatgacaggggaccggcggtcagcaagctggtcacaggtgaggttggccaggctggcattggcacagtcttcatggcggaagatctccacgcagtcgggagtgttccaggtgtggccacatgtggcccagggcagcgtggtggtaaaggacttgaccaggtaatagaagccccaggccagcaccatgatgtagtaggtgttgcagtagaagacgatcaccatggaggcgtagcccaggcctggggccgggaagtccttgccatgtagattcttccctggccacctccccctgccacccctttatgtccccacccaggctggccgtgctcccaccatctgtcctcctggagccttgtttgtggtgctcctgactcccctgggctcccccttgtgtgagccccaacactgcgctgactccccagcctgtctcctctcctccagccgccccctagacccaaggcagagcgagcccctctcctcctgtccccatctgaccaagtgctgtggagtctccagcctcatacacctggccccttctgtgggtcccactgccaccatggcggttccaggaggtccaagcctctgcctggccacccagtagcctccagtcctcagcagctggtgttgatggtggtggtggggggggggggtttctagtcgcctgaggtagtgttggagacagtcgcccctgcagtgggcaacctcagtacgtcgctccacctgtctgtgccccagcgtccttggggatagtaacagtaggacctacctagagagccaagggtgctgctgggcaggtcccgtccccagcccggctatgcctggcctgtccttgccttgtggagctgcctatgccccctctagtccccgcttccccaagttcgctgtgcggcctgaacatctcctccaggctcccccctcgagactgggacgccatcacgtggccccaggcctggtgctcacgacaggaaaagatttctcaagtgggagccagctgggagaagggggcagtccctgaggctggccaagggctgctcacctttgaacaggggacagatgttccagacattgatgctgccggccttcatgaactggcccagcgagatctctaagaagaaaatggggattcctccaaccagggcgatcaggacgtagggaataaggaacacacctgggggtggaggcacagcgtggactcagggtggcccccagccaggctgcccaggcccagcgggccagcccagactccaaaggccccatcacaacttccgactgggtgagtcagtgtaggggtggccactgactcaggccccaggtggagtcttgagggggtgggttgagtgtgttgaagaggggctacagtagcccctgagccattggagccctattccctgggtggcagaggggccctaggcccccagggcttccacccccacggtcacttggggcgatggccatggaggacacacacgctcagacacgcgggctgtccctagtgctgcaattccctgtttcaggcagcacagtgagggcacgtgcatgtgtgcatgtgtgccaaggctgggtgatcaggcctggggggctcatccaaaggcagggagcgcgactgtcctgcccttggacgcttgcctgcaagtgtgaggtctaaggcagagggtgggtgggtcacagtcccctgctggtgggatggcgatgtgcaaggacagagggatacaggtgcggaagaggggccaggccggccttagcaaggccagggagtcaggctctgcaggagataggcagggcgtgacacaggcctatctcctgaggccagcaggctggggtgggggtggcagaagggcagggagagctgggtgccactacccccttctcctctctgggcctcctacccttgccctggctgggctcgctccactactcagaggctgagcttggctgcaacttgcctgactccaggtcccagcatccttctcctgaccttgggcaaaggcctttgctctggacctctgtttcccacccatcaccgggtcacttcggcttccagcaaccccagtgctgttttgtagtcacaggacacacgcgtgcccatcgctgttgctaagctgggcccgggcgggcgggcgggcgggcgggcatgggacgtgcatgcagtgtgtccagtggcggcgccaggcgggccaggccgcaggcttcccaagcctggctcgggcacccagtgttccaggcccgggccagaggggaggggcgggagggccgcgaggggaggggagggcagggggagggacagagtggcccattgtgtgtgtgtgtgttcgtgtgtgtgcacacgtggggggcccacacaatgtgccgcttgtgtgcccgacccgtgggggcagccagggctccttacctcgcggagaccccaaggcgcaggcctgctttcccacctcggcggccaatcgctcctcccagcccgggagtctggggggcagcctcgcgggcatcgccggccccctccccccaccatgccaggcacatgactgcgaggggggtggaggcgcccggcccggccaccgagcggcagcggcggacgaggggcggccccgacccccgcgtgcccgggggccacccgttgcccggacttcacccctccgcggcggctccgggggtcgggcgggggccggcggcctgctgggggaggaggccgcggcgggcgggggaactcacctccgccgttcttgtagcacaggtaggggaagcgccacacgttgcccaagcccacggcgaagcccacgcacgacatgatgaagtccatctggcgcgtccaggtctcgcgcggcggcacggccaggcggccgccgggtgtccccaggcccacggggccgtcgcccttggccggggccccgtcgggcccgggcgcgatgagggggcccttcttctcgtcgccggacacgctatagatgccgttctcggcgctcttcttcgccatggcctcggcgggccgcacggccgggccggggtcgcggcgcctcacggggggcggcggtcaggcggggggcaccggcggcaccggggagggccccgagggcgcgggccggccgggggccggggggcggccgggccgggggacggggcggcgggcgggcggcggggtgcggggcgcgggcggcgcagtcagaagcagtccacgaagcacttgaaagtgagcctgaagaatctcatgtgtgtcgggggcccgggggcgcgcgggcggcggcggggcccggccgggcggcggcggcggcggcggcggctcccgaggctcctgcccgcggctcgggcggcggcggctgcggcggctcctcgcccgacccgaggctcagcctagcggggcgcgggcgacatcggcgcccgcggtctgcaagcggcggccggagcaggggcctgtggcccgcgccccccgccccggccggggcccgcggaggctgcccggctggcccgcgactccggtggcggtggtggcggcggcggcggtggcggcggcggcggcggctcgggcgcgcctcgccctctccttcccggcggcggcggctgcagccgctctcggggccgcggcgggctcagcgactcgccacctcgctccgactatccctctcttccccgtccccggccggccgccgcttaaaaaccgactccggggtgatgtcactatcgccccacccccacggccggccggcccccctccccctccccctcccgcatccctccctcccgccctcctcgtcacactccgcccacctcctccctgccctcctcccggggaggagacgccgctccagcgggaggcaggatggttgctacctggggcggccgccagctcctcccgcagggctccgggccgcccctcgccccagggtcgccggctcctagtgcagcccaggcttcccggccggcccctcccagccctgggaagacgtcccccgggccccctcagccctccgcctccccttctctccctttctccccgctcctggcaggctgcagccgtctcctcccggtgctccctccttccttgagctctctccaccgctgcccactgggggctacagcttcccggctaccctggaagctggaggccgggaccagctcttcaggtgacaggcctctgtgtctccacagtgggcagaggggagcctgcctggctgatgagcaagcctcgactttgtcatcaaggcagagaaggggcccgggtaaatgaccccggcggcccccacccctgcctggcgtgagagtgggtaggggcttcggacttgaggggactggagcgggaacaaggcaaggctgccccctggtgcctggcaggtgcacagacccttccccaaaggcctcaggcctgaggtcctggctgcccgccccccacccaccccgtgttcctctccccaggaccccccaggcctccctagcaagagccagcttgttgggctgcctctccgccgccagctgagcagcttgtttagaattttctagggctaagagtagcctgggggtggggtggggaaggaagtggtcattgtcctggcctgggaggtaaagtgtgcccccctcagcttcaagctccctgatctgatcgtggacactgcagtccccagatggctcatcccgttaagctaagcccgcggccatccgtccagctttaggaagaaaagcagttccggcccaagccagattgagcttgctgggtgagggagggacagtgtccccacccaggcttggaggaggagcctcaaggggtgtgtgtggttgggggagacaggcggtgtcacctgtgcttagaccaggggtggtgggtgggtacccctgaggtggcaaggtcacactgctcatcagaagtttctcactagggtcttctctggcccagcctttgactgaagctggtctggagacaggggcattagagaagtgactcatagatggcctaaagaagcggggccactcaaggacccaggacagagggaagagggccaacccagctggaccacaggcaaaccccattgcctttgagagaaagaagaggacccggtgaagtaggctcggagggcctcagcccagcaggagtgcggggtgggcgcgtgatgtcatcgaagggaggacggtgacctgggggagggccgctttgagggagagtgcaggccacggccagacagctctgggagccgcgggcaggggagactttcagatgttgcttgtcaaaggggtgggggtggaagggagagaaagcagaggctcgagaaggatgtaggagagctgatggcactttggggaagtgaccactgctgcggttactcctccggtgggttccgaggccagggacaggatcatgagggagtcgccacccctgactgctgctgcctttgtgagatcagaggaggccgaggcagagggcgaggtggccaggctggagggtactggagacagaagtgaagggtggggggctgtccagaatggctgccactgctccatggaccctcggagtgggagcccccacatctgaggggaggtccagtgggcccccatacctgactcccacgacctcctggaactgggctcttctccaggcagccaccccttcccacacccaccttcttccccgccctttgccagcccagcctggggtgcacccactaccagcccctgggccaggccctgcctcccgcccccagctggtctggaccccatagtgactgtgaactcctcctcacggcctgggccagaccccaaactgcattctctgagcagccagagggaccctcctgaagcacaaatctgaccagcccctcctttatctcatcccttctttgggcttttctgtgccctggaggtagaactaaatttttctccaagactacgagatggagtgtgatggggctgtgccctcccagcctcggggcgttccccctgagttttccctccacgcggggcccacagcctgggcttccctttctctgctgacctccaggactctgtcccaggaggctcctgagggaggttcaggaaccctccccacgtcggccaccctgggagccgcccctgcccagccagggcgagctgggcctctttgagcagtgcatgaagttcaggctggtaaggctggagtttccggcggggagctccggccggagctctggtctctgtcacaggctctgacccgggcggccagtgacagggtcttctgaggctgctcccacgagctgctgagcagttgggggaacaaaggcaaagcgatttccatccctggctgggtcctctcccacgtccgaaggcttcaaagcgttctcgggctttgtcaaggcgcgtcaggctcggcccgggggcagcagctgctggggaggggcagggtgggctctccaggcccccagctgagggccgggtagctgtcccccgccagccctttccaagcctccgcctgtcttgccaggcccttgtgttctactcactgaaggggggttccgagcatgtgcaggagggggtgggggtgccctgcgacctgtgcccagcccagagctcctatggtggcttctgggtgagaagcaaactgttctctggggcagaggcgaccggggaggggcggggggagagctgcaccctccccttaccgtgtcccagggagtgggcagcctttcaggccccagctggggctggggggttggagtaggagctgaggaggagggagaggggaggagaaggggagctggggggagggcaggggaggggggctagccggaatgctcctgtttgttgggggaggcctgagaattggagccagcgcccactcaagcctagggcagctgcggaccggggaggggctgggtgaggggccaccgggccctggggtgactggttatcctgggaggatgggcagctggagacaggatgggggcgcctcctcttctgaaggcgagccgggcacaatgagctttggaattagaataagctgggaacaaagggggagccagagtccacctggaagggctttgtacttccagctcctggggagggggccgacgtgcggctgcagccaagcggagaacagaaagaatggggctgggggcgagggcctgcagcagggcagggatggggggcagcagaaccccccacccgcgcccttcccaccagctgtgctcgtttacacagacccgcagaaaggaggctttgctttgttttttacattttatgtaaacttttattaggctggttttatttgttttatagattgagagggtacaagcgcggttctgttacatgcatatattccgtgcagacccatcaccctaaagctgccttgcaaaaactgtaacagtaacaaaattctgccagtgagagagctgatctaaccaaccctgtctgcatttaccctccaaactgtttttggtctttcctgggcatgggccaagctaactttgggagaaatttcgtttatagtttaaatgataacagaccttcccaagatgaaaccgcctttgtaaaagtaatgaaaggccatcaggtgaggaggatgagaggggcctgaattctgctaacatggaagcattcatgatgaccagccattgttcagagctcaagagatttgtaacttctccaattactcctgtagataatgtcactattgtagaacctaaggttggctttttgagacgtctttgcaggtttttgcatttctcactaccagatggctccacccggaccacatagacctatgactcaaggtcctgtggccctacctaaaagcagactcagctcagcacacaagaatcatcccccacccaaccagtcagcagcacccattccctagccccctgtccgccaaactatctttaaaaaatcctagctttcgggctgggtgcggtggctcacacctgtaatcctagcactttgggaggcccaggcgggtgggtcacttgaggtcaggagttcaagagcagcctggccaacatggtgaaacccctgtctctactaaaaatacaaaagttagccggaaatcgcttgaacccgggaggtggaggttgcagtgagccaagattgtgccactgcactccagcctgggcaacagagtgagactctgtctcaaaaaaaaaacctagccttcagggctgggcacggtggctcatgcctgtaatctcaacactttgggaggccaacatgggtggatcacgaggtcaggagatcaagaccatccaggctaacatggtgaagccccgtctctactaaaaatacaaaaaattaaccaggtgtggtggcacgggcctgtaatcccagctactcaggaggctgaggcaggagaatcgcttgaacctgggaggcggagcttgcagtgagcctagctcatgccactgcactccagcctgggcgacagagcgagactccatctcaaaaaaataaaaaataaataaataaatcccagccttcaaattttcagggcagctgatttgagtaataataaaactccagtctcctctacgtgtattcaactctttctcggctgggcctggtgactcacacctgtaatcccagcactttgggaggaccaggtgggcagattgtctcacacgtccatgtgaagagactaccaaacaggctctgtgtgagcaacaaggctgtttattttacctgggtgcaggcaggctgagtccgaaaagagagtcagcaaagggtgatgggattatcattagttcttataggttttgggataggcgctggagttaggagcaatgttttgtgggcaggaggtggatctcacaaagtacattctcaagggtggggagaattacaaattacaaagaaccttctcaagggtgagggagattacaaagaactttcttaagggtgggggagattacaaagtacatcagttagggtggggcagaaacaaatcacaatggtggaatgtcatcagttaaggctattttcacttcttttgtggatcttcagttgcttcaggccatctggatgtatatgtgcaggtcacaggggatatgatggcttagcttgggctcagaggcctgacacagatcacttgatcccaggggttcgagaccagcctgggcaacatagcgaaaccttgtctctacaaaaaatttaaaaattagctggggcggtgacacgcacctgtgctcccagctatggggaggctgaggcaagaggatcacttgagctcaagaggtcaagggtgccgtgagccgtgattgtaccactgcactccagcctgagagacagtgcgacaccctgcctcaaaacaaaacaggccggtgcggtggcccacacctgtaatcccagcactttgtgaggccgaggcaggcagatcacctgaggtcaggagttagagaccagcctggccaacatggtgaaaccctgtccctactaaaaatacaaaaattagccagacacggtggtgcgtgcctgtagtcccagttactcgggaggctggggctggagaattgtttgaacccaggaggcggaggttgcagtgagctgagatcgcgccactgcactccagcctgggtgacagagcaagactctgtctcaaacaaacaaaacaaaactttattgtaattcccctgtcttgataaattggctctatctatctgggcagtgagcaaaatgaacccattaggtggttacaacctgaatagtgaacgttgtacccaataggtaatttttcaaccctcaccttctagactagttttagatgtacagaaaaactgtaaagagggtaccaagaattcccatacagcccacccccatctcccgccttattagcctcttatgttaggacagctcatttattgcaattaatgaatcaacatcagttattgcaaacaatgaatcaacactgttagtatctaaagcccatagtttattcaggttttcttggcttttccctaatgtcctttttctgtcaggatcacatgttgcatttagtcatcctgtctcctgaggctcctcttggctgtgacagtttctcagactccttgttcttggtggccctaacagcttcgaggaggactgggcagtgtgttgtaaaacaacctctgttgggaaacttttgctgtttcccatgatcaggtgggcctcaggggtgatcaggaggaagaccacgggggtgaagcgcctcatcgggggccatgtagacctggaacgaccggctggggtcctgtttgtcgggtctctccactgggaagtgactgttccccctttccataccgtgctcttgggaaggaagccgctccgtgaggcccagttagggagcggggccacctcctggaggggcagtatctacacaagtaatgttttgttctgtgcaggagtgttgtctgttctcccacatttatttatgtaatcatttatttataacggtatggactcatagatgtgtaccttatatttggttttaatctaacacaactctttattttcttgctcaaattttccatcttggaccattggactctctttcggttggctcctgtgtcctttgtccttttttttttttttttttttttgagacaggttctcactctgttgcccaggcgggcggacagttgtgtgatctccgctcactgcaacctccgcctcctgggctaaagcaattctcccacttcagccccccaagtagctgggactacaggcacccaccaccacgcccggctaatttttgtattttttggtagagacagtttcaccatgttggccaggctgatctcgaactcttgacctcagatgatccaccctcctcggcctcccaaagtgctgggattacaggcatgagccaccgcgcccagccctgaaggctaggtttttttttgagacagagtctcactctgttgcccaggctggagtgcagtggcacaatcttggctcactgcaacctccacctcccgggttcaagtgattctcctgcctcagcctcccaagtagctgggactacagctctttatctgtcatatgtgagcccgttcttgcattgctataaaaaaaaaatctgaggctgggtaatttataaagaaaagtggcttattttggctcatggttctggagactatacaggaagtgtggtgccagcatctgcttctagtgacaccctcaggaagcttccattcatggtggaaggtgaagagggagccggcatatccatggcaagaatgggagcaagagagtgagggtggaggaggtgctagactctttcaaacaaccagatctcgtatggactcagagcaagaactcactcattattgtgaggacggcaccacgccattcatgagggatccaccgccatgacccaaaaacgtaccattagacgccaccttgaacattggggattatagttcaacatgagatttggaggggacagacatccaaaccgtatcacatcaccaccacccaaccaacacacatacatttcaaagttgacacgtacaggatttcagcagatgtttacacagttgcaaagggtgtaatttcttttctcttttctttttgagttgtgctatcactctctggttgccagggtggagtgcagtggcatgatcatggctcactgcagcctccaactcctggactcaagtgatcctgctgcctcagcctcccaagtaactgagactatgggtacacaccaccacacccggctaatttgtaaattttttgaagaagatggggtcttggcaaggtgcggtggctcatgcctgtaatcccagcactttgggaggccgaggcaggtggatcacctgaggtcaggagttcgagaccagcctggccaacatggtgaaaccctgcctctactaaaaatacaaaaattagctgggcatggtgacgggtgcctgtaatcccagctactcgggaggctgaggcaggagaatcgcttgaactcaggaggcagaggttgcagtgagctgagattgcaccactgcactccagcctgggcaacagaataagactgtgtctcaaaaaaaaaaaaaaaaaaaaaaagaaaagaaaagaaaagaaaaatcccaactcaataagaaaacaacccaatttaaaaatgggcaaaagatctgaacagatgcctctccaaagaagaaatacaaatggcaaataagcatatcagaagatgtttaacagcatacatctttagggaattgcaaattaaaaccacaaggagataccgctgcatacctactagatagccaaaatccaaaacactgacaactcctaatgctggcgaggacctggagcagcaagaactcccactcattgctggtgagaatgtgacgaggtacagccaccctgaaaagcggttggcagttccttccgaagctaagtatactcttaccatacaattcagcaatcacactccttggtatttacccaaatgatttgaaaacttatgtccacacaaaaaccaccccacatatatttatagcagcctttttttccttaaagaccagtgcgatagtattagcagctttattcgtaattggcaaaaactggaagcaattaagatgttcctcagtaggtgaacaaataaaatgtggtatatctggacaatggaatactagtcagtgataaagaggggaaagctatgaacccatgcaaagaaataagttaatcttaaatacatattgcatagtaaaaagcctgacaaagctacctactctatgactccatttacctgacattccggaaaaagcaaaatagattaaaaaaaaaaaaaaaaagacagaaaacggatccatggttgccaggggtctgagagaggggatcgtgcttggtaggcgcagcacagggattctgtagcacagggaaactgttctgtatgatgctgtaatggtggacacgtgacactctgaatatgtcaaaacccatagaactttacagcagacagagggaacttaaaataggcatctgtcagactaagagcaaaaggaagaacacataagcgccgcactctaattgataagatcaccccccaccagggtagaggtgaatgattctgcaacctctccacctttataccggaattcaagaactacggcaatggatggaagacggtgggagccaggtttctcactttaattttaatttttaattttatttttagagacaggatcttgctgtgtggcccaggctggagtgcagtggcacaatcatggctcactgtagccttgacctcctaggctcaagagatcctcctaactcagcctcccgagtaggtgggaccacaggcatgcaccaccatgcctggctaatttttcatatttctggtagatttggggtttcaccatgttggccacgcttgtcttgaactccagatctcagatgatccatctgcctcagcctcccaaagtgctggggttacaggcatgagccaccgtgcctggcctgggtttctcacttttagagtgggaggttatagacaagcaagggcaggcagctagaatgacccaggtggtgatggattagagttggagacatcagtgtgcactcctgttgagtttaatatagatactgatgcgcgtgtgtatctgtttatagatgttatgttagtaacataacatgggttggtatatatattaaatgggtattatatgggcttgtatatctatctatctatatgtacatgggttagtgtatatatatacactatatatactacatatctatctatatgtacatgggttagtgtatatatacacactatatacagactatatatacactatatacactatatatatacatacacactatatatacacacactatatacacactatatatatacacactatatatacacactatatatacacactatatatacactatatatatgcactatatatatacacacactatatatacactatatatacacactatatatatatacacactatatatatacactatatatatacacactatatatatacactatatatatacacactatatatatatatacactatatatacacactatatatacacactatatatatatacacactatgtatatatatgtatatacacacacacactataagttcttgctgtcagtggagagggcctagaagcagcaatactccaggaacaatgggcacacctagcgcccagatcttcgtctccaacaccattctctcaaaaatggctccttagagaaaacggctgcttctaggaccggttcaggaaatataagggatgagcacagagccagaaagtaaggaagggctcacagagacagacacgcccacacctacacgggcatgcacacacacatgcagtgatgaacggacatcaaaaggacacaggtggctgggcgcggtggctcacgcctgtaatcccagcactttgggaggccgaggagggtggatcatctgaggtcaggagttcgagatcagcctgccaacatggtgaaactgtctctacccaaaaatacaaaaattagcccagcgtggtggcgggtgcctgtagtcccagctacttgggaggctgaagtgggagaatcgcttgagcccaggaggcggaggtcgtagtgagcggagatcacacaattgcctgccagcctgggtgacaagactgagactccatgttagaaatgtttgttccccggtggcacaaagaaatagcacttgaacataaatttaattttctttttctttctttctttctttttttttttttttgagatgaagtctcactcttgtgccccaggctggggtgcaatggcacgatcttggctcactgcaacctccacctcccaggttcaagctattctcctgcctcagactcccaagtagttgggattacaggcgtgagccaccatgcccggctaatttttacatttttagtagagacggggtttcaccatgttggccaggctggtgtcgaactcctgacctcaggtgatttgcccaccttggcctcccaaactgctaggattacaggcatgagccaccacacccggcataagtttaatctccttagcaaggccattttttaactttctgcggaaagggtacactcgccagcagttttgccacatgagtacaccaaacaaaggagggaagcaatttttattccttatgccgtttgtccttgctactgtgtcctgtttccattggctgcagccagacctcacaatctaacctaaaacccgattggctagtagtttaaaacttttgaaaatagataaaagtaatggaaggataaaggaaaagaggaagttgcttacgaaacggcttagaaaagtaataatattccccaataggaaagggagataggctgcgagctgggacatgcctgtgagcacgtccagcacagatatcttggttaaagtacaaggacatagaatgtactacgtgcctgtaagcatgtttaacagctacataggatagggcttaacaaagagttattagcacaaagcaaggaggcttgaaggaagttagtctttaaaagaaactattatttctaaacttatgatttattttttaataagaagggaaactttgaagaggaactttttactttctacactccatctcaaaaaaaaaaaaaaaaaaagaaaagaaaaaaaagaaaagaaaagctatgttgcccaggctaggctggaactcctgggctcaagtgatcctccagcctcagcctcctgaagtgctgggattacaggcataagccaccttgccaggccggagggtgtaatttctcttgtaaacacacaatataggcctggtgcggtggctcacgcctgtaatcccagcactttgggatgctgaggcaggcagatcacctgaggtcaggagttcgagaccagcctggccaacatggtaaaaccctgcctctactaaaaatacaaaaattagcttggtgtggtggcatgcacctgtagtcccagctactcgaggctgaggcgggagaattgcttgaacccaggaggcagaggctgcagtgagctgagatggcactactgcactccagcctgggcgacagtgagaccctgtctcaaacaacaacaacaataacaaaccaaaaaaaaccccatgatacaatgattcaaacaaaaactgtgccatcagcttttacatgaggccagggccacctgagtcacctcgtggaccaatacctgcccgctggctcgtctttcccaggcccactttggaggtgggtgctttccttctggcctccagtttccatctgctgcccctcagataggtctctttgtgccatctctttccacgcgggcagttttttattacttttctggggcacagaaatatgtgtatttctatttctttttataacccaggaccatgttgtagaactctgcttgggcaaagcaccattggcgtattagacattctggggaactatctgtaggtatctgtaaacaaattgcacttcctgctgtcatgagaaggggctcaccatcagttccattcctatttttttctgttttagatgtcggtcccaggaaaccattttcacatagaggagcaggtgggactggagtttctgagtgctggggtccctggagccttctgcagtgtcctgggaggggtgactgggaaaggccagggggcaagagctgctaggggccttctcagatttcccagtttttacacagagtatatatgggagttgaggtctggaaaaatgattttttaaaaactcttcctgccccgtggactctcttgaagacgtcgtgtcatgccagggcccacggtcacttgacggaacccttgtgatgctggccacaacctcatgggactggatggcgagcagcgaggggggtccagtaactgttggatgcaggattgaattcggtcacccgcacttatttcctgggctcgtcttggttgggttcgcggagatacactctctgggagcggacgctttggtgaggaagaccaggcgaagaaggtgatttttgcggttggacgttctaaagacagggcagggttatgcggagagaattggcaggggcagggcgggggaggccggtttgaggaggggacatttgagccgagatctgatggaacgaggagccaagccaggcagatatctgatcgaagaacattccaggcaggggagcaaaggctagggccgtcaggaggccagtgtggccggggaagaggtggaggaggaggggccagggcagtcgttaggccgccccctaaggactcatgctttgacttggattgacatagagagctgcaggagggtgacatgatctcaataaaaggaatgctctggctgctgggtagagaagaaagcgagggtgagggattaatggtggagccagagggagcccagtgagtgccgggagcccagggtggcagagctgtggtgcagggttgcagggtcctggagctaggcatggaggctgctttcgggcaagtggccgggtcagcctgtcctcggagaggcggtgaaggcagagactggaaggcagagagccttgccgacctgtggccgaagagctctccgggagacagccaccggtggtgcaaaggccctggggccggcccagccgggccgcagctccgggaggcggcgcgagcgagcagtgggctgggcggtggcggccggcacccgagccggatcccggcgattgccttacaaggtgccctgcggcgccgcggccgcgctgggccactgcgtgcttgggcggctggcgggggcgtgcgcggagggggcggggccggcggggcgcgggcggggggcttggcgctgcggccactgcgcggcacgacgctgcggcacccgctccaggtctgcacctgctccggggcgcggggacgcgcggggcgggggcgcaccggatccggcccgcggccgccgcagccttgcgcgtccgcagcacacctgtcacgcctggcgcgccccctgcccgcacgcgctcggtccacgcagctcgggacgcgggcggcccaggctgccaggtccccctgctccgcggcgccgagggctgggctgcgtctgcggccgcgtgggtggccgcggtcttggcaggtggctgcgcgcgggggtcgcaggtgcatcccgggcggcttggtggcttgggcagcgggtgcctgtgggcgctgtgccatgggtggcgggtctaggcgggggtgggggcttgggcgctgtagatgtgtggatgggggagggacggcgtgggtgagcatggagccttctggaaagcggccggatgtgtggaggcagagaggcagcatccaggcgctggtcgccttcggggtgcgggggagggtgcgtgggatagcagctgtaggcctgggatgtggaggcgtgtatgcggtggcctcgctgggaggcgtccgtctgggggtgtggacctggacgggggaggggagggtcgagcgcgcagcggcaatggctgaggcctgcctggcagggggtggaggaggaagctgcccttgcccccggcggggcggggagagacccccatcacctctcccctgcccctgcagacatgctgctgctgaagaaacacacggaggacatcagcagcgtctacgagatccgcgagaggctcggctcgtgagtgtgcgcgcgcgtgtgtgatcgtgtgtgtgtgtgtgtgtgtgtgtgtgtacctgtgtgagatggcatgtgtgtgtgactacgcgagtgggtgtgagatgatgtgtgtgtgtgtgaatatgtaggggtgtgtgaatgtgagtgagtctgtgagatggcatgtgtgagtggtggtggggggtggcacagggccaggtagggcctccccatctccttcacagggggccctccccgctccactctctctccctcctgcctctcctctcttcccacttccttcccacctcccaccgccccgtctgcggcaggggtgccttctccgaggtggtgctggcccaggagcggggctccgcacacctcgtggccctcaagtgcatccccaagaaggccctccggggcaaggaggccctggtggagaacgagatcgcagtgctccgtaggtgcgcacctcgcggggccctgggacggggcataggtcgatgggggggtgcaagcagtccttggctctagtccaggcctggccaccaacctttgggaggcctggggcagtgctctctctgggcctgcacatccctgtggcaaagggagtgagttgatattgatctgtgcttttcaaatgggctttagaaggaaggccggggctcaggctggagctctgccttcctggaccgggcaggggtggcatgtggtagggaatggggagcagaggtgggaggaagagaagagggaggaggctttccccagggcctcaggacagagcaccccttgactctgttggcccacaggcgcttccttgccattgcaggatcagtcaccccaacatcgtcgctctggaggatgtccacgagagcccttcccacctctacctggccatggaactgtgaggagggcctgggcaggctgtgggagccggggagggactgagcagtgagtggggctgaaggccaggctgagtgcctgggtcagccaaacccctggcacccccagggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaaggtgcctggctggggcctctgcaccccaccctcccacctgcccacctggccctgcctttgttttcccgggagcacggctggggcctttcttgatctcctgctccaccaaggctctggggaacctgagagtgcctagtccccatcctgtcccagcaccggcaccgcgtcaggactgactggcccttttcccggtgtccgtgtgtcacagcccgaaaacctcctgtatgccacgccctttgaggactcgaagatcatggtctctgactttggactctccaaaatccaggctgggaacatgctaggcaccgcctgtgggacccctggatatgtgggtgagggacgacaccctgaggcttgctgggagtggggtggcctgggggaccctagacagccgggaaggctgttgtgcccgttgcctttgtgtgggccattcctgggcttgagtaggccgagccagtgacactgagcggcatggctgcgtgtgtgcctgtgcgtgcgtctgtctgtctctggcccccagccccagagctcttggagcagaaaccctacgggaaggccgtagatgtgtgggccctgggcgtcatctcctacatcctgtgagtgaccgctgggaaggcttgtctcctgcctgcctgcccctgctgggttggggagggtgggacagctggatgattcatctgtgggtgccaggctgtgtgggtacccccccttctacgacgagagcgaccctgagctcttcagccagatcctgagggccagctatgagtttgactctcctttctgggatgacatctcagaatcaggtgagcttgaggctggcccgtgcttggaggtgatgcaagggagtggggacctgacaggctgacccagcctccctgttccagccaaagacttcatccggcaccttctggagcgagacccccagaagaggttcacctgccaacaggccttgcggcacctttggtgagtgggagccctgctgagctgccccagggccagggggcctgcatttgcagagagaccccccctgaccttcagcctttccccaggatctctggggacacagccttcgacagggacatcttaggctctgtcagtgagcagatccggaagaactttgctcggacacactggaaggtcagtgtggagagagacccagtgtggtcgcccgccgcaccccagctgtagcctgatcgccgtggctgcccagtgaccactgcagtcctcacagtctaggggctggggcctgggcccaggcctggcctgatctccctctcttctggcagcgagccttcaatgccacctcgttcctgcgccacatccggaagctggggcagatcccagagggcgagggggcctctgagcagggcatggcccgccacagccactcaggcctccgtgctggccagccccccaagtggtgatgcccaggtgtgtttgggtggaccctgcacgcccaggagctggctccttggagagcttagagggtggtggcgctccatgtggccaagagctaagtggggtggcccccacaggccagaggactgaaggcagagagcagagggaggagccagggccccaggagaggtggaaggacagggagggccagtgggtgcttgacattgggcaagggggtgcagggggagagggcctctaagaagtccgggatttgaccgaggcggggggtgggggcacagggctggcaggccggctcctgactaccccctttccctctgcttctccctctcaggcagatgccgaggccaagtggactgacccccagatttccttcccttggatgctttcggtcccctcccccaacccctccccctggggctggcctctgctggattttgagatttgagggtgtggcgcatggcgctggggttggaatggggcacccccaagtctgtccccaggctctgccctgcctgggggcagtggctcccctcccctgttgcctctcccgcccctgccccccccgccccgccaaaagccgagggggtgctggcaggcgggcctcaggggctgtctttcctgcacggctgttgtgtgcttcgctgagtgtgggtggtcctgcttgtgtcatggtcatggccttccagccccctccagttttccccaaaccaataaagaaagatacagcaatgggccagtggtgacctgggggtgcggcgagtgtggaggggacctggtcacttgtgggaaggaaaccaatgagagcctgccacacggcttcgcccactgccacctgaacctctgcttccccagacaagtttccaactgtccaaaaacttcctgtcccctccccccaaagcaccaacaagtggcagcgtggccgggcagctctgccaccccagaggtgtaactgcccagccttggggtcctgggacaaagtggaggcagcgcacgcctgctgggctgccagcagggggcgcagtcaggaggctgagtgctggctccagacccccagggatgtgctccagtgcccctgccatgcagggccgggcctggggtgcctcagccaggtgcctgggactgggaagggctcacaggtgcatggagggcgaccagagcccaggactgtcaccttccatccctccctcccttccctttcttgatggccagaggccatcttgtcgagcagaagagtaggggaccccagggtcagggggtgagaggagctccttgtccaggagagggcgacacagggccctcttcccctctgctgtgcgggggctttggaaccctcaggctccaggctggggtagacctgggctggcagctggggctctgggagcagtggcagcttggcggtggcttctgaagtggagagccgtggcctgtcctctggtctgagtggccccagccccaccaacctccattttggaggggccagggctccagagccctgccttgctgggtcccaaagctctgctggcccctctaggcctttctcttgggcccatcaggggaagacccctagagccacttcttggccccagcgagagttccaggcaagctggccacccctccctccactctgagacccttgctccctgccagccctcagagtgtaagcctgatgacccatggcttgactggcgagaatggtagagaagatcactctccttgttgaactttgggccccaaagggaggcggtgaggctcaaaccaaggctggcctgggtcttgtgggtgaaggctggagtggggttcagggttggagccaggggacctggcttccaccagggagagcaggctggaggtgggtgggcagcctcctcctccatccccacagccgctcccaggccatccttcgctccaggctttgggccccacaggggacctcagtcagccagtaccacggcttcctcgcctccaagacctgtcccacctgccctcacccctacgtggggccttgttgcctgtgggcacccctgctgtgggccccccttcccatcttctctgttgttcacactggactcccacgatacctacttgctgttgttttggtcagatgttgactgagcctctactctgggccaggtgctgggcactgacctgggcctatcagaagaggcgcctgccctccaggaggacgccctctattggaggggtggttttacggggatgataaaaatgatctttgtgggtctgggagcaatgagcaggagtgccagagccagccttacagaagaaaccggcactcgctcagaacagccagctcttccagtccaggcacgtggccagatcgcttcggcttggagcttaagccagctctgggctgccttgacacagggtgcaatatggcctcccgtcagcagggggagccacggccccatctttagacgtccattagcctccctagttccttcagcaccctgggcagcctctcaaatccattcctctccgcgactgcccctaccccacaccctgcaaatcctgccttggggaagtccaaccttgggggagaggtcctgcccatctgtgataggggcgagagggggaacccccaggtcaagcagaggcggcacccctccttcatccctccgagaccgcatatgaggaaggcagtttgggtcacctaggcagtgggatggcagcctgggagagagaaaggactggtttagccaaaggcaaaaggtggtgtgtgtgtgtgaagtgatggcaagggagctgtgctggacactgtgagggcttctcaggctcagggctggtgctgaggctggcagcaagaggaacgggccagaccaagcctggcaggggaaggagctggagctgtagtctaggagcagtggggagccatcgaaggggtttgtagccagagagcatccttgcccagtgtgggttaggtgctgagccggggccggctgctaggaattggggtgtctggaaccagaccagaattgagggtcaggggaaccctggtgggcatcacaaaaggaagctgtctctgctgttctgggccacacagggtgggtcacgtgctctatcttgaagcaaacctgtgggtagcggagtttcaagggaagctcaacctgtgggtccaccctagggacagggagacacggaggtggtcctaggagctctttgggagtcatgtggacaggtcttggtgatgggttgcaggtggggaatgaagcggggggatccaggtagatcatgtttctggcagcagaacattcatcaagaagagttcaacgggcattactttgggggaggagtaatgagattgattctggatgtggtgagttcgaggtgcctgacgggcatgaaagtagacttacttttcacccttctctttgcaaatatgtatctagcattgtatctggtatttctggaaggcttattccttttaataaaaagaacactgatccctcgagcccaggagttcgagactagcctgggtaagatggcgagaacccacctttacaaaaaaaaaaaaaaaaaaaaagcatgctagtaacgactctttattgaagagctttccatgtattaacttgaacctcacctgtgagatagctgctatcatgatcatcatccccacttcacatatggagaaactgaggcatacagaggctaagtgagccaaagccatacagcttgtggcacagtgaggatttgaacccacactctgccactgcatcctcttgcttgcatccatgcaagcgaggtcttgcttgggacatgattgtgtggggaattgaagaaaacaaggcggcattctttccccacttctctttgtgaatgcaaactctgtgtgtctgaaggaaagagaaccctgggctgggggaacccacgctggatttgagttggggtcttgcagatggtttgtgttgccatttttttttttttttttacgagatgaggtctcactgtgttgcccaggctggagtgcagtggctattcacttcacaagtgtgatcctactactgatcagcacacgagttttgacctactccgtttccgacctgggctgtttcacccctccgcaggcaacctagtggtcctctgctcccagaatattgatgctgaacttagtacggacacctgatggacatagcacactacagcccagaactcctgggctcaagtcatccccaacctcccgagtagctaggactacaggtgtgagccaccatgccacctggcttgtgttgcctttaagctcctctgtgcctcaattttatgtcctgttaagtgggaaccagggaggtctttgcacagtggtggaaatggggcatgggagctgggccctacaaagatccctttggagttcggtgtgagcgatggcctggaagtggggcagggcagggctggtggctgggagacaagcctgaaccatgtggagaacaaggcaagagatgtgggactactggaaagatggagcttggtcatcgactcaatgggggtggtgggggggttgtgagggagttgaggatgctgccagggaacccgggagagcaacaggtctgttgaagagacgaagtgaccaagtcgggccccctggccaggcggtggctgagttggcactataagccacatgtttcttcctgccaggcactgtctgggcatgtggcaaccatgttctccaccccaccccagcttcatccacggatccctatcactagccccaacaccaggtgggcaagataagaagtatggaatgtttcagaaataacaaagaatcccgtctggttgagggaggttgtgagaggaggtgggtagagatcagcctggaaagtgaactttctcaagagggcactgggagccacggacgttttaaacagaacaagtgacaggatctgatttttgctttaagataatttttcaatatttttcaaccctattatctgcccccttttgagaaatagaaaaagcccatgcttactatcatgctggtctttaaaaaacaaaagctcatgcccatctctccagagctcctccctcacaccccgtggagatttccacagtttccctcaccccagggaaccaagtctttcctcacatgatgtcctgagtagaggctcaactgctttttgccagtttctccttgtagttctttcaattattgctttatgtatttataagttatgttattcagtgtatttgagtttagaattggtatgtattttaggtaagttgaatatttgatcaaaatatagtgatatatgttaatactagcaatgattttcccttatagtctacttggtctgatattaacatagcaactataactttttttggttaacatttaactggtatagttttttcaatccttttccgttcaaattaaaaatttgtttttattgagatacaattcacataccataaaattcaccctgtaaaacgtacaattcagcagtgtttagtatatttacagtgttttgcagccatcaccaccatctaattccagaacattttgatcaccccaaaaggaaaccttgtacacatttgcagtagctccccatttacacaccgcacccccccccaccagtgcttggcaaccactaattgactttctatctttgtggatttgcttatttcaatatttcaaataaatggaatcataccatacatgggcttttgtgtctggcttactcttactatgatgttttcagggttcatccatattgtagcatggatcagtactccattcctttttacagctgaagaatattttattgtatggatagaccacattttattaactatcgatggacatttgggttgtttccacttttagctgttgtgaataatgctgctatgaacaactgtgtgcaagtttttgtgtggatgtggattttcaattgtcttgagtatatacctaggagtagaattgctgggccatatgataactccatgtttaacttttgaaggaaatgccaagctgttttccaaagcaacggcaccattttacattcccaccagcaatgcgtgaagttcaaatttctctccatccttgtcaacacttgttattgtgtgtgatttttaaaatagccattctagtgtgtgtgaaatgctatctcattgtggttttgatttgtattgctctaatgaccaatgatattgagcatcttttcatgtatttattatttatatatcttatttggaaaaatgttcattcgaaacttctgttctttttttaattggataattcatcttttaattgttgagctgtaagggttctttatgtattctggatattagatccttatcagatatatgatttgtaaatattttctcccattctgtggattatcttttcactctttgatagtgtcttttgatgcacatgggttttttttttttttttttttttttgagatggagtttcactgttgtcacccaggctggagtgcagtggcatgatcttggctcactgcaacctctgcctcccgggttcaaatgattctcctgcctcagtctcccaagtagctgggattgcaggtgtctgccaccatgcctggctaattttttttgtatttttagtagagacggggtttcaccatgtaggccaggctggtctcgaacttctgacctcaggagatctgcccatctcagcctcccaaagtgctgggattacaggcgtgagcccccgcgcccagccagagagtgttgctatgttaaaacgatgttgttttccaatccatgaacacagaatatcattccacttattttgctctttaatttttttaatgatgttttacagttttcagtgtatacatttcgcacttcttttgttaaatttatttgtaaattttattctttttatgctcttgtacacagaattgttttcataatttcatttttgaattgttcgttaaaagtgtatagaagtaaccattgattttctttgtatattgatcttgtattctgcggccttgctaaactttttattagctctctctctctctcttttgggggggactggggtcttgctctgtcacccaggctagaggctggagtgcagtggtgcaatcatagctcactgcagccttgaactcctgggctcaagcaaatcctcccctctcagcctccagagtagctgggactacaggagcaggccaccatgctcggttctaatttactttactttattttatttattttattttattttattttattttatttttagagatggagtctcactatgctgcacacgtgggtgttgaactcctgggctcaagtaatcctcctgcctcagcctcccaaagcactgggattataggcataagccaccatgcctggccctttttattagttctagtaggttttatttgtgtggattctttgtgattttctacacacagcacgtgtcatctgcaagtaaagaaaatttttacttattcctttccaattgggatgcttataatttccttgttcccttccttttctctttttttctttttgtttctccagcttattgcactaccaagaacctccaatactacattaaatacaagtggtaaaagaatcctttccttgttcctaatcttagagggaaaacgtttagtctttcatcatcaagtatgatgttagctgtggatttttcatagatgccctttatcgtgagtaacttccattctgttcctagtttgtagaaaggtttttttttttggggggggggtggggggcgttcctgagtttatttggggcacacccgggcgagggccctgcccttagaagaaggtatcgggcctcttggtggtgaagcgtggtttgtgctgacggcgcaggaccctgtggggcagcgggaacttgatcttggagtcgtggaactgcttgacggtcggccggcggcacttgctggctgcgatgtcctccaccttcctgatctggatggagtgggcccgggcgcggtgccgggcgcccatgtctcgatagcacttggtgacagcgcccgcggtggtcaggtcccggtattcccggtatatgttgtgggtgccgcgccgggagtcatagcgcagccagatgccgaagttcttcacccgcagggggcgcttctcaaacacctgcccacagtagacaatctcccctgaagacttcttcagcttctttaactgagatacgaagtaccagaagtgggacttagcgacgacatgattaggagcaaagattcgcatgcggtagaggggcggtgtgtggcatttgggggcgggcaggcagcgacccaccacctggtactctagtcgtgtgcccggggccttcatggcgtcctctgcgctcgccgccacccgcaaaaggactgttttaaatcatgaatggatgttagattctgtcgaatctttttatgcacctattgagaggatcatacggtttttgtccttttctgttcatgtggtggatgacactgagtttcagatgtcaaatcaagcttgggttcttggtataaatcccacttgatgatggtgcccaatccttaggtgctgctagatttagtttttaaatattgtgttacagatgtttgcatccaggagttcatgaaggatattgatatgtagcttttttccttgtgatatacttggtgcaagggtaatactgggctgatagaatgagatggaaagtgttcttactcctctattttctgaaagagtctgtgaaggattggcattaatcattctttagttatttgatagaattcaccagtgaagccatcggggcttggattttttttgtgggaatattttcaagtactaattcaatttattttcttggtataggtctattcagatttttaatttattttaaagtcagttttggtcatgtgtctttctaggaatttctccatttcatctgagttgtccagtgtttttggcataaagtggtcaaagcattctcttataatcctttaaatttctataggtcagtagtaatgccccccttttctcttcttgatattggtaatttgattctcttttctttttggtcactctacccaagacaattttgctgatttttcaaagagctgacttttcttttcattgatttttctctattgttttcctgttttcaattccattagtttctgtgctaatctttatttccttccttctgcttgctttgggtttagcatgctcttctttttctaatttgtcaaggtagagacgtaggttattaatttgagatctttctttttttgctggtataggcctttaaagctgtaagtttccttctaagtactgctttagctgcattccataaattttgatatgttttgttttcattttcattctcatttcattctttctaatttcctttgttttttatttgacgtgccagttatttagaagagtgttgtataatttccaagtattttggacttcctaggtttctatctttttagatttataatttaattctgttgcagtcagagaaatattttatattatttaaattatttaaattcctttaaatatattgagacttgttttatggtctatcctggagaatgtttcatgtgcacttgaaaaaaatgtgtatttggcaattgttgaatggtgtgttctataggtatcagttaggtcaaatttgttgatagtgttgttcagattttatatatccttgctgatcttctgtctagttccatcaactattgaaaatagagcattgaaatgtccatctgttatatttgaattttcttttgtatttttagtagagacagggtttccccatgtcggccaggctggtcttgaactcctgacctcaagtgatctgcccgcctcggcctcgcaaagtgctgggattacaggcgtgagccaccgtgctggccaattttcctctgttgatttttaattacattgaagcagaaatttagacataaacatgcttcattcactccaagtttgagttattttcttagggttttctctagctattacattatgagtcttaactaatcacaatccacctcagatgaatactcacttaattttggtgaaatatggagactttgcctcagtatggctacattctttcccacttcttttgtgctagtaatgccatgtttattacatctatataggttataagccctgaaatacagtgtaatacctattttttaatgcaatcttatgtttttaaaagagaagaaatgaataaaaatatgttgagaggcttttatattagctcacttattaaccattttttctgctctccatttcttactttgaattccagttactaactggtgtcatttcctttcagcctgaaggacttccttgagtatttcttgtaaggaggcaggctagcaatgaactatgttagcctttgtttatctgggaatgtctttttttaaaccttcaattttttttttttttttttttttttttttgagatggagcctctctctgtcacccaggctggagtgcagtgatgtgatctcggctcactgcaacctctgcctcccaggttcaagcgattctcatgcctcagcctcccaagtagctgggattacaggtgcatgccaccatgtctggctaattattgtatttttagtagagacggggtttcaccatgttggtcaggttggtctcgaactcctgacctcaggtgatccgcctgccttggcctcccaaagtgttgagattacaggcgtgagccaccgcacccagctatgcacccagcttcaatttttaaagcatagttttgctagatataaaatttgggggctgggtgcagtggttcacacctgtaatctgagcactttggtaggctgaggcaggcagatcatttgagcccaggaggttgaggctgcgatgagctgagatcacaccactgcactccagcctgggtgacagactgagactctgtctcaaaacaaattttttttggttgatagtatttttttctttcagtgctttcagtttgttgttccactcccttgtggcctccattgtttctgatgagaagtcagatgttaattttattgtggttcccttctatatgggtcatttatttcttctgctataatactttcaaaattgtctgtctttggctttcgataatttaccatgaaatgtctatgagtggctctctttgtgtttatctcacttggggttattcgaacttcttggatctgatgaatgcttttcaccaaatgctggtgtttagccattatttattcaaatatttattctgcccctttctctttctcctcttcctcagagcctccaattacacatatcaaaatatgtgttcagttttaagtctgttctggttttacttcttcttaggagacactgatgacttgcaggctccttacatgctggaccagaaactgaaattcctctctgtcacccaggctggagtgcactggtgtgatcacggctcactgcaacctccacctcctgagctcaagcaatcctcctgctgcagccttctgagtagctgggactataggtgtgcaccaccacgcctggctaattttttgtatttttttgtagagatggggttgtgccatacttcccagagtggtcttgaagtcctgggctcaagcaatccatatgggccacatttttatgtctcttctatctgagtcagaaagccgggatgtagagctctcctagtctgtctcctttctctcagggaccacagtccttcactgattgctgtcccccatctgaaaacaatggattttcatatattttgcccaatttctagctgtttatggtgagacagtaattctggaccctcttattccctcatggccgtattgatattgagagactttatgttttgttaagacaaatatacatgttaaattttttagagtaactagaatataaataggatgtactacttccaaactagtagaagaaaatagcaaataatgaaggaaaattcagctaatcacaaaaaggtcaagtaagggaaataaagaaatggaaacggggctgggcgcggtggctcacgcctgtaatcccagcactttgggaggccgaggcgggtggatcacgaggtcaggcgatggagaccatcctggctaacacggtgaaaccccatctctactaaaaatacaaaaaattagtcacacgtggtggcgggcacctgtagtcccagctaattgggaggctgaagcaggagaatggcatgaacccaggaggcagagcttgcagtgagccgagatcgtgccactccagcctgggccacagagcgagactccgtctcaaaaaaaaaaaaaaaaaaaaaaaaaagaaaccaaaacgttggaataagcagaaagtataacataatatgttaaaaatagatccaaaaaacattaagcaaaataaatagattaaattatccagttaggatttttaaaaaatccagctataagctgtttataagagatatatctaaagaatagggccaaaaaaggctgaaagggcaggactggctgggcacagtagtggctcacgcctgaaatcccagcacttggggaggccaaggcgggaagatcacttgagcccaggagtttgagaccagtttaggcaacatagtgagacccccgtctcgacaaaaaaataaaaaaattagttgggtgtggtggtgcgaacctgtggtcccaactacttgggaggctgaggcaggaggatcacttgaaccgggaggttgaggctgcagtgagctgtgattttgccactgtactccagcctgggtgactgagtgagaccctgtctgaaaaaaaaaaaaaaagagaagaaaagaaaaagaaagggcagaacctccagctatggccaaacgtggataacagcaaacaacctccccaaaaaagtaactataaagctggaccaaactgacaaaaacaagctttttgatctggaagtcaacggaagatgactcataatccaagtggctggattttgagtaagaacagcgggagtctgtggcattctggcccagggctgctcccatccctcctggcttgctggacatggaggctatgccaaggcggggaaggccatgaagaccagcagcttctccccataggcttgaagggcgctcgctcatttggattggtgggcaacacctgtgcccagtggtgtcatcggtggaagtgacttcttggaggtgggcgggttgggaagggcaaacagatcagctctactcaactgaggctatggatgtgcttgcggcagtatatttctagctgaccagagactggaggggtcccatgctactcacgctctcctggactgccctgggactatgcacgtgtatataagagatgtgagagggcccagtggaaaggaaagcccagaagaccttaaagcagcctgaacattgaataagctcccctacccacacccagacccaaggacacaagccttactggcttgagatgtttgagcacagcttctgtccagtcattggctgaccaccaagctaggcagatacagggtagctcctaggaaaccaggcttaaaatttttaactagaatatatattttttaaatggaaaaaatcttccctgccagcccacctccaagaagtcacttccaccgatcatgccgctgggcacaggtgttgcccaccaatcatccaaatgagcgagcgcctttcaagcctatggggagaagctgctggtcttcatggccttcccctccttggcatagcttccatgcccagcaagccaggagggatgggagcagccctgggccagaatgccacagactcccgctgttcttactcaaaatccagccacttggattatgagacattttccgttgacttccagatcaaaaagcttgtttttgtcaattttgtccagctttatataaagttacttttttggggaggttatttgctgatatctgcatttggccataggtggaggtcctgccctttttttttttttttccagacagggtctcactcagtcacccaggctggagtgcagtggcaaaatcacggctcactgcagcctcaacctcctggttcaagtgatcctcctgcctcagtctcccacgtagctgagaccgtaggtgcgcaccaccatgcctgactaattttttgatagtttcagggctttttttctttttttttttttctttttgagacggagtctcgctctgtcacccaggctggagtgcagtggctggatctcggctcactgcaacctccgcctcctgggttcaagcgattctcctgcctcagcctcctgagtagctggtatcacaggcgcccgcaccaccatgcccagctaatttttgtgtttttagtagagaccacgtttcaccatgttggtcaggctggtgtcgaactcctaacctcaggtgatctgcccgcctcggcctcccaaagtgctgggattacaggcgtgagtcgccgtgcctgggccttcttttttaaaaaaaaaattaaaaaaaattgtttttgtagagacggggtctcactatgttgcccaaactggtctcaaactcctgggctcaagtgatcttctcgccttgacctccccaagtgctgggattgagtgtatgagccaccactgtgcccagccagtcctgccctttcaaccttttctggttctaccctttagatgcgtctctggtaaacagcttatagctggattttttaaaatccagtctaaccggagaatttaatctatttattttgcttaatgctttttggatctatttctttttttctttctttctttctttttttttttgagacagagtctcactctgttgcccaggctggagtgcagtggctcgatcttggctcactgcaagctccgcctcccaggttcatgccattctcctgcctcagcctcccaagtagctgggactacaggtgcccgccaccacgcccggctaatttttgtatttttagtagaaacagggtttcaccatgttagccaggatggtctcgattgcctcacctcgtgatccgcccgcctcggcctcccaaagtgctgggattacaggcgtgagccaccgtgcctggccgtcttttggatctatttctaacatattatactttctacttattccaatgtttctgtttctttatttcccttacttgacctttttttgattagttgatattttccttcattatttgcttttttcctctactagtttggaagtagtatatcctatttatattctagttatgctaaaaaatttaatatgcttatttgtcttaacaaaatgtaaagtcactcaatatcaatatgaccatgagggaataggagggtccagaattactgtctcaccataaacagctagaaactgggcaaaatatatgaaaatccattgttttcagatgggggacagcagtcagtgaaggactgtggtccctgagagaaaggagacagactaagagagctctacatcccggctttctgactcaggtagaagaagcataaaaatgtgagccatcatgagaagaaaaatcggtcaatagaaacagacccaggggagtttctgttgctggtccagtgtgtaaggaggccagaagtcatcggtctgtcctaagaacgagtaaaagtggaacacatttaaaatcaacaactcctcttagatttatcagagaattgaagtcactgggcaaaatgctgcccccaaaattggggagacagacaggtgggcacagagaatcacaacttagcagagcaggaggccaggcacaggaaccagtgctggcgtagggacacccgaactgcaattgctgaattgctgggggctcagtgcggacaagtctgagagttaaaactctgggatggggcagtcttttggggctcccatacttttgtaagttttacctttaggagctcaaccaggttctcacagtgagaaaaatctcatcatgcttctggcagggggaggggaaagtggtcattttgaaatacgcccagggcgttcctttcttaactaggcctgccctcaagagtaacccttaccaggcccaacctattagggttttggcggagcctaactgacctgagggaagcgaaatacccaactcagtcttttgtagccatcctggcccacctaagcggggcacaatctgagaagcattggtgaaattcacagtccaggggcataggcacgcccaaagacagaaacctaatcacaggactgaatgcttttcctccctccacattctgctgtatcactacggcctattcgcagcaggtccttttacccagtatgtgtccagcttttgacaaaaaaaacaaaaagtaaaaaaaagacaagtcatactaaaggccaaaaaacatagttcaaaaagatagagccagtaccagaagcagactcagctatgacaggggtgttggaatgatcagaccagaagtttaaaataactatgattaaaatgctaagggctctaatggaaatatgagacaatatgcaaaaacatggccacaattagccgcaagggaggatgggaaataaagtttttagctgtgaagccatacacgctattaacctttgggcattttatttctaaaaaggagaagcagagaatggatactgggggacactcagcagtctcttccacggtgtctttcatcagttttggaaatttctcaggcattgtttattaaaatactttatattccctattctcctttttttcttctagaaatccaactaaatatatgtgtgacctgtctgtcttattgtctgtctgtgctgcattctgggtaatttccttaaatccatcttccagttcactatttctttcttcagctatgtttaatatgctgtttaaactttaaatgtccaatttcaattgtcatatttttcatttctaggagctctttttggttttctttcaagcgtatctagtcattttatattctcttgcttttttattacagtttcaatatttccttttatttctttaagcatattaattatacttatagtctgttatataatttcaaaggctgctatctttgcaggactgatacttgaattcacatgctaaatgtttctataactcatggtggcttgtttccttgtacattttaggattttaaaaaattacgtattttggaattttctatagcggtgctttgaggcctgtgtttaaaggacatccctccctccacagaggatttgtgcttgcttctgctggtcactctggagcaatatgacctctgaaccacttcatttaaaacttaaataggccaggtgcggtggctcatgcctgtaatctcagcactttgggaggctgaggcactgcacctggcctatttaagttctatattgagaccttgtttctaaaataagaaactttaaaaatgtattttatttatgttttaaactgctatttttattgggctgtcacaatctcagtaaaccctgtaggtaagatagtcgaatgcagcttcaagacaaatccaggagccttctccagcagccagatcactgtttcttgttttgttttgttttgttttgtttgtttgttttgagacagggcctcactctcactctctcatcactctgtcactctgtcatgcaggctggagtgcagtggcgcaatcccagcttactgcaacctccgcctcctgggttcaagtgcttcttgtgcctcaacctcccaagtagctgggattacaggcacgtgccaccatgcccagctcagttttttttttttttttttttttttgtatttttagtagagacagggtttccccatgttggccgggctggtcttgaactcctgacctcaggtgagcctcccaaagtactgggattacaggtgtaagccaccgtgcccggctgaatcactgtttctaagtacctctgagagagattctggagtgtccactactctatgcctagaccactctaaaagaacagttcagcttgtggctataagctctcaggggagggggaacattttccttttattccacttccccccagatccaaggtcaagatcagcacacaccctcttctttatttgggatatatcttcctaggtcacctgttctagtagatttctgtggctgctgtaataaattaccacagagttagtggcttacagcaacacagatttcacatcttccatttcagtagatcagccattcaaaatagatttcactggacagaaatcaaggtgttggtggggctgcgttccagtggagggtcctggctcctgggctaaccccagagtggcttactccgctggcccagaggattcacctcatttctcagttcatcaccttgctcttcctttcctaccagctcagccattcacgcatatgcctttagattgtgggttctgggccacattgctccaaagcctccacagctttctctggctgcactcgctccccgccaccctccagctgcccttcccctctactacatgtccatggtggagagtcacagccttatagaccccaccagttatggtgtggagaaggcacttgcagtgtcccaatatgaggagaggtgcagttcacctctgtccctttaggtggcccgttggtctccatgttctccatggggctcttctagtccccagcctgggcctttgcagcccaaattccacagccagacaaccacaacactcacatgtgccagtctgcccacacccctccctgtcactctcaggatgccacccagccggggcagccctcaggaggctccaggcagggctcggggctgacttggccggtgtctcagggatcagttgtgagtgctggcccctcacttttctgctctgtccatggcaatgaacgtctacggcacaaccgcagtgctgtgactgttgcatttgtcgtttcttcccccactagaaagtctgctgtgagcaggcggagctcactgctgcaacctagtccccaggacagtgtgtggcacagactaggggttcaaatggaggtgaatgaatgggcgactcagagcgtgggccagcgggcagtgtaagcacaagatgggaaatgataacatggggcagggagtggggtggcacttgagtccctggccagcctggcacatgcccctttccaccatgggcagtccagagagaccaagagggcctccttccccaccttcccccaaaccctccaaggcgctcaggaggtagcttctctctctactcagtatcttaaataaactgtttattcagaaggaacaattaaagaaagcaactatgatatggattacaaaaacaaacaagcatagatcctctccaggctccagggtgagacggccccacgctgcaaagactgccagccctgggctgggtgcatcagtgggctagcatgtgtgtgtgagcgccgacacgtgcgcacacacaagcacacacacgcacacccgccacccacaggggtgtggacagaaatgaatgactgtgtgtgtctgcagcttggccccttccccaccccccaaagtagcagcggctgtgtgggccccgcagcagcaaaagtgaggccttcttcttcccctccccctccgcagctctcgctctgagaccccatctcctccggcggtagtttggccaccctcactcacaaagagccccagtgatcccgtcaagacatctgggggaagaggaaaaaaaaaaaacaaaacagcccaccagatgtgtggccgggaacctgcccagtagctcctaggccatggatgtgggcggccactgcactctgggtccccatcccctgggaggccccagccccgagaggcccaagcccttggtggagaaacagggaggtgacaacaccagtgatggcaaacgcctctcccccaagcagccactgggatccagtgcaacgaggtggcacacacccttcctgaagggggaagcgcagggaggcgcagggcctagccgagctggctgagcacccagggccgggacatgggcctggacaaccacctggagagggaacccccacccccatcccgcaaagaaaaagtaacagtcgcagaagaggcaggctccgagcgtggtcccgccataggcacgttgattaggacggcagcccgcgtgaggtattgcgctctccccccagcaccctgctcaggccgagccctcctgccctcccctcccttgccacacgagtgggcagggacacccgtgggtgggggtggggcaggggccggcctgccggccacggggccctaggtgggggccagctcgaaggcgccatcactggtgggggtggtgaagaaggagggcgggttggaggccgcagatgcctgccccccactgccctgctcctgcgagtggcgctcctccagccgcaagctgcgctcaaagtccagcaactgccccatgaagttgaagttgggggagatgttagacttcttcctcttgaccaggtcataggcatcgttgagagagaggtggagcttctgcatgaggtaggccacagtgacggtgacagaacggctgacccccgccaagcagtggacgagcaccccgcagttctgggacaaggcctcatctagatggggcaggaaagggcccgggagacccggagggcaggcgtgtgtgaggccgaggccttccgaagggccctcaaaggccccgccctgccccctgggccagatggccacgacctgcaggtttctctagtggcctctgggggccgccctagctctgcctgtcccctagaactgtcacctaggcttttggctctgggaatggcagcggggcttgggaggagtactcacaagggggaggccagagcaggccttggggaggacaggagggaagggtgggtggggtggactcaccaatgaactcaatggcctccggaaagaaccgcgacaggttctggctccagtggtcggagatggggatctgcttgtagtgaaagtcaccattcttctcgaagaagtttgggaggttgggggtgacattgaggatgtagcggatgcccagtttggccaggctctccaaattggcggaatcccgggcactgcccagatagaggttgggcaggatctggacagggaaggatgcccgcagccccactggtgggggtgtggcaccctccgaatccaggccacagctcatggagtcgcggtcagcctcggattccgcatcagagcagtcggagcccaggcacaggctgcccaaccccaccacgggcactggaccgggcaccggcgccatgctggagccggcacggccagcaaggctggtctcacacaggtgagggcactcggcctggaatctgctgaagcctcctgttggggagagggcatggggcctgctgacctggccttctgggcagccaagtgcctctgtctggggctggggagatgaccctggacaacttggagggtttgcaaatgttcccaaagggaacacaaaacccagcagcttggtgtgtcctggtacccacgtggggccctagccaccctcagtcagctcgggctgcaagaagctgggctcacgctgagccaccggaaaggatcttacacccctagggtcaagctgaggcaggtgtgagggctcaacagagccgagatgcactgccagccttagggaggactgcggccatcagctaaagaaaaggaggaactcagatgtcagctctctgcctgggcatctcctgactctcagggatgaagtgggaccccaagatgtgggggaacttgggggagaatatggctcaagaagccagcatctctatttacagatactatttccccgggctggacacctgaacactttatatgctgttcgggaggctaaggcaggaggatcgcttgagcccaggaggcttcagtgagccgtgattgcaccagtgctgtctgacccctgcctcccttgctcattcctgagcaggttggggaggtggggatacccttgccgagaccctggggagcccgcactttgtaattcgttcttgagcatcctgagaactagctcaggtcaggctaattctccccattttccaggctcagagactgggctgccgagggtgaagaacttccccacggtcacactcaggcttccctcctctcaaagcagcctggcaggtcatcaggggaggggggcctcaactcgctttagaaaaaaagaagtggggctggcctaaggtcaaatgaatcccgaaccccctggaaggagggccccgcggcacctaccctggaggtagtaggccaggtagccttcctctcgcagcttctgcagcagggtgcccagcaccgactcggcctcccactcctcggcctcggcctcggcctccccgcgccggcgccggcccccgccctggtcgtacaggagcacgggggcaggcgggggcggctgcagcggcggcccaggcaggagcgcgcgcaccgacaggctgcccctccgcaggcggcgcagcaggagcgccggcagggccacgctcagcgccccaccgatgcgcgccgactcgtacagctcgcggctgcggcagtccaggagcaggagccgcggccgcgggggcgacagctcccgacgcagccacaggcacgagcggcccagaccctccatgggcgatcggctccctacacgctggaccacgggcgctgcgaagagagagaaggcgcggtgtgagctaccggagggccgagggggctcagacttgaagccggccccgcgtcctgaaggcgggagcccagggtcccccaccatgaggactcccaacaaggcgccccaagaaaccccccaggcagcagctcggcccggggaagggtcctcgagaagagggctgagcggctaaccgccccttcgaggctcatcttggggtaccctgaggtcgcagccgcctccctccataccccctttctgctcctgtctcggtcttctcgcgaacgctccccaagttcgagcttccgactctggctgggggtgtgcgtgcgaggagtgccgttcgaggcctagatctcccccagggccaggtgggccaggggaacagaggaggcgccgaggtgctgggcctcagcgagtcctctcagaggtggtctggcccccggtcccccatctccccctacccctaggagagaacaaaaggaaagagacctggagcgagatccggcggtggacgaccgcgcgtggacgttctggccacggccactgccacggcggaacgcgaggcgccgtcccgcggcagagagtccccaggcctggccgccaggagagggcggggcggcggtgcaggctcgcacgtggaagccgagccccgcgcagcccgcgcagcccgcgcaccggccgcttcctggcagccggacccagcttccaccttggaaactgccttcggacgtggagttacaactccgaggggcgggccggggcggggctccgggggcgggcccggcgggccggtgagccaacgggtgctagccgaagcagtcgggtgggacctgcgagtcggctgagctggggcttccaccgaggcgggacggggtcggggcagaggccaagggcaggtcaggggcccagcaggggaccagctgcggctcccctggccggcgccagcctggcctcgggaggcagggggaggggtgaggaccagagcccagcccctctgccgcagaagctgcctccagcccaactcacagggtgatactggagcatcttctcccctgcctggatctcagtggccccatctctgtaatgggctcagagctagcagcttgggcaaacttgggatgccaccgaaatcacggaggggaggaggaggcaggaccagaaacttagtgcagctttggcccagaggtctgctgcagggctaggcaggcaggggtagctcctggatacctaccaataccagcccgcttcactcgcacaggactggccaaaagcacccaggaaccctgagctcccagccctaaactggggcactctgctcttatcacattactgatcctaagagtcacccgtggctcccccctctgcctccttcccttaaccccccttcggctaatcaaagtggaaagaactagtttctacctaaatatctctcacatccacgcctctctcccctgtcccttgccctagccgagggctcaaattcatcagctttaggccaggtcactgtcacgtcttgcacaacagtctccctgcctccgggcctgcaacgacctgccctccaccctgccctgcccagccctgcccaacgtcagaatgccatccactcaaccaaggctggtggcctccatcctttcctccatgggcacaacaggcgggacagatccacaggcagcaagagcactggacaaggtctcaggtgtggtgagcactgaggcaggagaccagggtcagggggaggtgtccacaatgctgatctggctaaaagtcccttctctgcttaaagctcaacaaaagcaaataacagtgttgaaggaaaatgtacgccagataagataaagctcatacccaactaaaaggttaagacccctgtagataaatgggcaaagaacctgaaaacactgcatactgcaggaaggagggaatgcggtggcctaacaaatatttgggggaaggttcaacttcaggcgtggaaggaaagccactccaataaacaagtaacaatgaccaacgaggtaacacttcccacctactgcattagaaatgttctcatttttgagaacacgcagtgctggcaagattgctgtgaaatcagcgtgctgttcaactgttgcagggttatatattggtacggcccctttggaaattaatctggcaatatcaagagctaggaaaaaatcccaaccctttgaccacttttgggaatctaaggaactaaagtaaaagaaagcaaagttatgcacacgaggatgggcaccacaaagcatttttctaacaagtggaaaatgcaaagcaaactacgagtctaaagactcctctcaggagccatggagttagaggagaaaatgtctcaggtcatggttaggtaagagggcaggtgacggaaagctaggtgggtcacctctaaggggcttccagtttgcctctctccctccctttcgggcagtgggctgctagccggggactcccaggaccctggcactgggctgctttccggccacaccccccatgtccctgcgtctaacaagagtcctaattcctgcatccaagggctttgggcagctggactgtgcccttccttctctcacccagtgggcaagggccccagcccaggcctccctcctatgccccctgcccagattctgagattctgctcattcttcaggccccctcctccaggcagccttcccaactcggagccagtagtctccctcctctgtgctccctagtgtggtcactttccccctttctcagtgtgttcctggggcagggactttgtcttctgttttctgtccacagcctagctccacagtggtggaggtggacaccggcacccagcctgggggctgcctccaggcccactgcagctgtgggtgggagctcagagtgggcaggggttgaaggcaccacggaggttctgccatgtgccagtcttgttgtggagagtgggggtggcgcagggctgtgaccagcagggagctggacagccacttccccggcccgccctgccgtgggggctcagttcggctagagagggagctcctgagctgctcagtggcgctctctggagagggttccctggaggtgagaggagctgggctggaatgaggacggggagaggcaacctccgcaatggggaagggaggggaagcctaggatccaagggtccacgtctcccgacgcttggcgaggggctcccctgcacctaactgcggagccctgctgccaagtcctcgcaccgggagaaagcatttgggaggaggccatgaggggctcaatttccaaagtcagagctcagtgctcggggcccacagcgcccgcagcgccagcaacaggacaaatgggaacctgttgccacctccgcactgcagggctgagcgcagccaaccccctaatccccctctcacccgcgaccctcgccgggccgcccccactcaggccccctgtagcgccggctctgggcgccgccccgccggcagccgctcccgggtgcgctgtgctgggggaggccgcgccgcgcgcccgggcctcgtctggccccctccggcgggctgagccaggccgcgcgctcgctgcccgccgcagggtgggcgctgcgcctgccgcccccgcccccgcccccgcacccgcccccgccgggcgccccgggcctccgccgggccgggccagcgccccctggaggccgcggggacgccgccgcctgcaggcctcgcgcgcgccgcgtgcgccctctggtcccgggagcctcccgagagcggcgccgcgccgccttcccccacgagatgcaccgttcccgccgggccgagtgacaggatttcggctgtcgcggccgggtcacatggccaagagcacaagtcccggcgacagcgtgcctgccaaatccagtgtcttttccaccaaatccactttctgctggggatggctttctgcttttcctggtcggtctcctcgcgggactgggagttcctccaaggcaggaacgggtgtgtgcccggccccaggctggccccagcccccagtgcagggcctggcacgcgcccggcgctcgcggaagaaatgctcgttaacaaagaaggcatgaatgaatgaaaccaattgttgcctgagggagctgctcctgcttttccttctgccgatcacacactcctcccccaccccgacacgcacaagcacacgtgcacacacagccctccccgtaacacacacgcaggcaggcacccagacagcgcgcgcggacgccagcccccatggaacccacctactacgtgcttgccgggcagctggcgcccctttggtcccacctgggccgcctccatttcagcgccgggctctctccgccgcctccccgcccctccccggggccccttgcttccacatctaagtaccctaccttggaccccaaagtgccttctttatttcttagggaagaggccaagctagtcgctggggagtctcaaggtctgtttagggaggcacctggggggcccaaggctgctgagcctctgccgaaggggagccagaggtgcctggcagggatgccaccaaatgctgcagcctctagagcccgcgtgccaggtgttgggggtgagggagggagggactcagagatgtgctggggggtgtcgaaggctatttgtgatgggggcggggcaggatgctggagagcgtgaatccagcaggtgtgcgcgcgtgctggggtggatgagagtgcgcgttggagatgctggaggtgtgtgcctgggacgtggggagcgtcagccactgggatgtgggtttctgacgggacctcgctccaggatgggtggactgcagtgtctctgggctggcaacgtgggtggggtgtctgtaatgggcagatggggagttcgaggtggtgggggcatggtagggggagctatgttggtgcaggtatggcagagacgtgttggaagcgtgcgtgtgcgcctgggtgtgtactggggcgtggcagggtctcggtgggttggcatgagttggggacagtggtgagtggtggggcaggggcagctagtgtgtgcactacaggcacccgggtctgtggtgcgtggtttgtatgcgcgcgagtgtgcagccggtgcaagtggcaggagacacgggaggtgcacgggcggcgtgcgggggtgtgcggagcagcaccgaatgggtgtcgtaggggcgcgtgcgccggcttcgtggggtgtgcgttgtcaggactttgggggtgcagggtggaggagcgcacgtcggggcgggggcagccaggccgggtggggggtgggggtccccggggcgccgcttgctccactcacctccgctctgctcggttctccgcgccggttccctgcgtcgcggccgggaagtttccgaagctcgggcggcgggaagcgccactgctgcagcctaacgccaccggaaccccgggtggcggcctctcctggagccgaggggcagccgccgccgccgctgcggagggaaactccaaatcccgcctccgccgccgctgcctcctccgcctctgccgccgcctcctcccctccagtcgccgtcttctccgccccctgcccaggaggggcactgtagctggcggctcgcggggagggagcggggaggggccgcggcctgcccggcgtctccctccacctcccacgccccccccaccccccgccgccttcctcccacctgcaagcctctgttctctaggccagtcctgcccgacgcgccctgcgctccccggtccccagtggcgccaatgagtgggggctccggcgcttggggcgcgggagtggggttgggggccctgaactaggctgggcctgggctaggtggacggttacgcgcagaatctgcactggcaccccagcgaaggggcccattgaggactgggcgcaacttggtgccccagagccacctcctgctcccacagtgaagagggtataaagtctggctgacagcgctgccaattccatcccccaccccaggtccccctgcagtgtctcctctcattctcatgtgtcagattctggctaatagtaatagcatttgagcctcagtgcctggaaggggtggagccaggacgtttgggtgggggaggggctggaagcgagtagggagcggctgttgtcactaggtcccgttagctttctcctttgtgccaaaggtcacacgcattgccatcaaggacctcattttatccttacagcagttccggaagtctgaggggattgtccccatgctacagccagggaaactgagtccgtggctccctggtggtggcacaatagtgtagtggcagagtaggatgtggcttgggctggctgagttcagaagcctagagcctgagcgagtgtgagtgcggaagattgcgtggggaggggaggcagaggacagcccgtggagatgtgcacctggcctttctggggctcccagaccagcagtgtatgagcccggcctcgtgcctgcagtgggggattgcctgagacccggcaggaggctgtgagcatcaagggccgtcttctccgcccagggagcgcaggataaggtgcggccaggcagggctgggatgccagcagctccgctggccgcttggctgtgtctgccgcagcgctgaattcccctgagtcattacccctggaagaggcgagggcagcagctttgcctctggagcccaggtccctgtcccatctgggtctccatttcctggtatgtacgtttggggagagaggtgggaccatgtgatctccaaggaccctcctagctgtgctgcagtttcaagccatggtgcgtgagctgggagggtcctgctgtcgccagccaggcctgcccaccctgctctgggccccgactgctcctctgcaccttttcagccttggcggcagcacagcccctcctgggagcaggcctctggccctgcaactgtcttcctgctctggacgctgggcctcatgggactgcactggggctctcccctacagccttggggagtcaggctgcccaggacttgagcttgcacctacccaaggctatgccacgcaggcgagcacatgcagctgccactggtgcccgtactgctagacgtgctgaagttacggaacctttcctaagaaatcaatattccatagaagctgtgccctacaaacaggggactgcctttcacactccccctccactgagggcacctcctgtttgggaaggacgtacgacagctgtgcccatggcctgggtgcccagctgacccccggcaaaggcttggtgggtgagctgactcggaggagcttctagcaaggtttgttaacatcctcccctccgccaccatcctgtgctttagtgactcagggctgagaggctggcggagaaacatttggattgaagaatgccaccctcgcccctgcacagctcccactcccagccctcctggtgtctctgctctccaggcaacaagacccatccgttgccggaagaggagcatgcaaaggccaggcctgcccggagatgcccggggagctcgtgaggcacaggcctgctcggcctcaggaaatagcggttccctcttcatccccagggctggggaagaaaatgcagaacactcccaagggggacttgagtgagtgcaagtttgcttggcagaaccgagggcacagctgggtctctgactccgaagcagctgggtccatctgctgctgacgggagtctcagggtgaggcgacggggccgccccagccctcgccctccattccacccggaaccccaaggccactgccgtccttcctgtcccttccttggggatggccattgggaagtggccatcttgtttcctgtcagaccccacgccctcccgaatcccaaaggtgctccccagagaccttgaaatcagacacaggaaccgccagccccgggcaaggtggaggggcacgggagctgcactttgctgggggtagagaggtctttagcctagcagtgcctctggcggccggcccaactcacaccctctgacatggagggctttggctgaaggcatccatatctgttaagggacagtttgttcagggcccgattccgggccactctccaggcaaatgaggttttggggagagaccgtgggaaaggtgatggccgtcaaagcctcacagctggcacaggggcaggcacgttcctgccataagccaagcgccctcctcagggccccgcccatggtccccacgctgccctgctgttggcttgtctcagcacaccacggcgcctgctgctgctgcctccgagtgctgggtcctccctgcctgtgtccctgcatggaacctggatcacatctgcgggctccggagccagggtgcacacacatccgagacttcatttctgggtaaccattgggtcccacagagatggcttctgcagctgaagccttctgttcacatgacaatccccccacccccctgcgccaaccctccaactcctccctctgcaccctcccatatctgaagcgcttcagccggcatcttctagatgtaccccgctaccagttaccatgtcttcagaagcaccctacctgtctgcagccgctcccaaaggagccctgcccagacatttgaaacaaaatggctctgaaatgtcacttgcagacgaggtcaaaggcaggccagccgggcagctgagtgcccaggggtgtgagcaccagggagggacaggaggtaggtgagagggaagggaggggggtagagcacagagcgccagcctgtgcagcgattgatttctgcgggccgggacctggtgagccattagcacccccatttggggagggctcaggttcaggttcaatacaattcccctctggccagctgcactggctccctctccttgtcttgtcctcccgagcagcagtgcatgtgcgtctggatatacattacagatgatataatccttttaccgggacagccagccacccacagccctgggctagacaggggaagggaagtgaggggagacaaggagcctctgtccagaccccatgcaggggaagaggaggagagagggcagcaggtgactttcccgcgtggcccagggacgtccagggctaagggaaccaggagagaggggagccaccaagggtgaaacgatgggtctggggagattgggggtgccaaggatgttcccagtccacctggctcccctgctgcagatccccccaacctttgccccgcctggcccaggaggaaaggcccacctgcctttctggccgcatttcagcatcccccaccccgtcccccttccaggaacatgcttctccagtcagggtgtctcaccacaggtaacaagataagacacgagacaggcagccatggccaggcccaggcaggggcttgtggcgagcgcttgccctggctcagatgtctgtgggggtggagagcggctcctggaggctgtgggtttttctcatctcactcctcgggggcctctgcccctgcgcgctcggtcacagcacctgttggcttgtctggctgcctccctccaccactccccatctcctcccagcaccgaaaggcccagcctggtgggccccattggcttcctgcacccagacccatccccaccctcaggctgctgagccccttgctgctctggcatctgggagcacccagcacctctcctgcccaccgctgccacttgcccaaggccctgcagcgatcaggggcacagctggagacagaatcacagctgtgggtgccacgagtcaccttccaggcaaggagtcccagctgatggagacttgtggcctccaggacaggggcgccgcgtgggccacccttggaagcacagctgtcctgaagcttccaccttgtgtgcaggccccttgggtaatggtgacagcagctccagggacagatgagggtctcctccctcccaccactggtgccgtgaccgtgaggacaagccatgctgtttgctgcacttcttgtttgcttctggatgaggatgctgaagtatggaatgtgggggcggtgaccgggctatgtgctcagttccacagactagcagccagggccccatggccagggcgcccctccgcagggaactgcctctgcccttgagtggctctttcttataggctgggggacaggcaggaggggagctgctggctcaggcctcagtcacctggcaagccacccacccggccagagcaaggaaggaggcagctccctcctggttgcagaagggtgctggagagccatgggtgcgaccggaattgcagagaagagctggcctgtccttgaatgtgggccgcccccaccagggtggagttcaaggctgtggtccagagcatgtgcaccccagcccaggtgtgggccttctcctctgtcaccttctcttagccctgctgccccccatccccgggttctcgctgccccctcttcattctcctgcctgagagcctcgccacaggaaggctcgggatatttctgccagctctctggggagttctcccgtctaaatttagagagcggctattacccctcagtacctgcttcccacatcggtggctgatttgggtcccgagggccccagagaggagagcagtgcagatgcggtgccacgtgacctgcccacacctcggggccggctcctgggcagagagaaggtggagaggagggggaaggtgagaaaggtggcagccacgtcccagggatcaaccgcatccacgcggagagggccagtgggcctctgcctgagagatgccatggatgggaaggggacagccaaggctccttgtgtggggtcaggcatgcagcctggcctttcccggtgggaggctgtggcaggtcactgagccccttccagggcttcttactgccctgcctgcaacgacagggtaaccatctccacagccatctcccttccaccactgcacactgcatgcccactgccatgtcagtgttatacagagaaaaggagggtgcacacaggcggctctgggagttagtcatcagtcctggccactgctgtcaccacctggagcagggcctgagactcgttcttcactgccttttgagctccaagaaggacggctgtggctgacatgggctgggaccatgagggtgacccagggtccagtctgtcagcctgtaaggctcagctctcaggatgcgtggttggagagctggccagagccatgaggaccatggctgcctgttcttctcagccctaaaggggaaagcaggggaggctgaggatgggatccccaggaccatgagcctaggtggacttcccagtcggcagggcagccagcttgagactggcttcctggaggggtgtgcgtcccgtctctagagggtccaagcagaagccgcaggctgctgcctttcttgtgctacccgctgcagtggtgagcccagccagagggaggtgtcacagatggctggtgctgaagctggctccttggcatctgaggattggcctgctcccagcactgccccctggctggctgtggtcagaattgccctatggtggatggtgggtggttctttggagctcagcacaggcaaggcagggagatctgcctggaagctcttgggccgggtctcctggcaggcggcgtctctggtgcatgctcacttccctcttctcggcccagctcagccagaacctcaagggccccaagggagccacagtgaaggcccttgctcggcctctgaagggtcttttgtgtcctcatagtttgggtcggtgctacctgtcgcttgtcacttctcatgttgcccgaagacctgtaggaccaggagctggtgatcctcagcagactgccatcctgtttctctgagcatgtcgcttattgattgttgttttgggggagggatgagtgtcgggacctcctagcccaccgcctggctgacttcactccagtgctcatacactggcctgtgacaccaggtctctgccccaggctcctgggcccagctgcccccaggtgggttcccttgggtgacctccaggcttctcaaactcacgtgtcccagacacaagcccagggctcttatctcagtgacagccacatcgggtctgcctgggtaggctctgtaggccgcaagggagagaagtgtccagaggctgtcttcaggaaaaggggacgtgtagtgcccagaacgtcctctcctcagccaagcccacctatcccccagggctcctcccatccccgtgtcctccatcctctggccctcatcccctggccaccagccttgagcctgcccatcctgacctccctaaaaggcctgagcatctcaaaattgttctgtgccaccccacagcttccaagttgagagccccctttggcctggtttctcctgagctgctgccggtgggtgctgtgtgttctcccacccgcctccccagagcccaggccagctggcatcgccttccttgagaagtggcggcttccagacgggactcatctgcctcctgccaaactccaaggcctgcaaggctcttcctccacctgcccctgcttgcttgggtcccctcctaaggcctccctcctcatgcccaccccctcctggttttctttccctcactctggccacttgtcccaagtctctttcttatgtccctcttctgggggacgactgtgacatcagtgtctcctgggttccatgcctgtagctccattgctgcctggatgtcccaaagttcttccctccacaccccaaactcgggggtgcccttgattcctctctctccataatcacccctcacattgctggattttctcttcacccaggccctgtcccctctcgcttggacgacggccccagcctcgcacccatcctccacatcaaggccagaggaagtgtccttgcccagatgcctggccacttctcctctcagcccccttcagtggcccctcgtggcctcaaggacaaagtccagctccacggccctgagccatctggctcctgctcgcttccccggagtcctctccccgacttcctccaggcccacattccagccccaactcgcgccttgcagttgccagaacgaagcaggatatcgcgtgttcccttgccttattctaaagaaggtcacatgctgaggctccaggtggacagatattttgggggggcactgtttagcgtgctgcagtcctctctctgttccctcacttcatgtccatcacatgtgcaaagtacattcacccacatctttgcctatgtgcctgcaccctcctgctgtacacgctgccccacatctgcctggcagggcactcatctttccagcctcccctcaatgctggtgctggcacgagagtcctttctttcctttgctaggaccacccaacacagaatgcctgtgtcctgcttgccccggaccactgctgtccttggctgaggagcagacgggacgtttggaggagcggcatctgtctccagggctttgcacccggcctggctctgggatggggccgtagcaatgtgtgtagaccccaggagggaaggaattaaagagcctgagatccctgctctggtggccctgtgcggctgtgtctgtaggtaggatggggcagtgggtggggagtgggtcagggctcctgggccactgcctggccccctgcgctccctccacccttcactgaaggaggaagccgggctatagcacaattgtgggagggggtgcctgagatggagatgggcagggttggggtgtcccccaaaggaggaggggagggggtgagcatgcagagcagaaatcaaccccttgaggtcctgtccccagcccagcagtgctctcccaatgctttctcggtggagagagtgggcatctgtccatgagcacagggttgtgcgagggggatgccgctgatgacagatgacgatgagaggcttggggcctggaggagcagctggacacggcctctgatgggctgtggggcgcactgacagagagatgcggaaccccacattcgtgtcatgtcctggcctgagaggggccctccagcctttgcaagatgccccactccctccaggcaccccttggcctgcagtgggcatggtccttacccccctcagcaggttgcttcttggctcggtgtcctggcaccgtgttccccgcctgcagtgtcctcccctcctccctgttggccccacagtgctgggcatgcccctcaggtgccctgcttccctcccgcgtggcatcggccagctggtgagggcatgggcactgcagatgcctctgtgctccagggtgcctggcatcgggcctgggcacagatttctggtgggttgtttatttatttatttattttttgagacagggtctcactctgtcacccaggctggagggcagtggatcaatcacagttcactgcagcctcaacccccaggctcaagcgatcctccacctcagccctccaagtagttgggacaacaggcacgcaccacccacttggctaatcaattttttttttttttttgttgagacagggtctccctatgttgtccagactggtctggaactcctgggctcaagtgatcctcctgcctgggcctcccaaagcgctgggattgcaggtgcgagccactgcactgggtaccgagttctgagtggagcatggcgaactggggcggctttctgcctggctacgctattggggcccagagaggcccatgcccgcaggtggcactcgaggcacaccccgcagtcccttccctgcccaggtcctccccctacccaggtcctccccctaccctcatcttggtgtgtaccatgcggcctcgttctttctgtggccttgtcctgtcttgaaaagactgggaattcctgggtgaggcccatgggcctgctgtggaatccctttctcccgtgcactggcgtgccccagagcccgagggcactgagccttttctccccctgcctctcacctgcccacctgtccccacttctgctccagggagcccgctgggtccctgttgctgctgtcagtcccttgtttctgccattccctttctctaaatgcaccctgacctctgttggaggcccctccggccttcccagcccagccccggcctagccctgctcccttctcctggcacctgggcacccttcatggtttcatgatgctccaggtggctgtgcgccgtctcagagagcacagagtgtggctgccagggccaggctggccacaggcctcccagtctccctcagctggcctggcctgaggcgggctggccaccccccaggggctggctaggcgtgcgctagaggaataaggggggacaggggcaggaggagggccagctgccatgtcatcacaatggtggtccctgggacacctctccctggaattctgtgaccagtcagctgcaggccttggttactgaggaaaccgaagcctcgtgtgagcgctcgtcatctgggaggagggattcaggcagagtgcgcctccgtgagggaccaggtgctcgggtgactgcccgaatcctcctgggcaggctcagagatgtgcgccgagagcctggctgctcccagggctgcagaggccctgggtgagatggggctggaagcagtgaggaagctggccctgtccggagccagagcagccacactatgtccacacatagctgtgcatataccttcacaaggacggggacagcagaacgcctctcagccacgtaggccaactggcaaggaggcagccaaggttgagctatatatatatgtatatatatatcaaaggatacaatagagacaaggctaacactttctagtacagccttagtatagagcttgctgtggaggcagagatccacaagccagagaacaccaaagatcagccacaacccgacagaagccaggggagaggcctgggacggacctttccctccagccttcagagggaccacagccctgccgacaccctgatcttgaacttctggcctccagagctgggagagaataaatgtgtgctgttttcacacatcccgtgtgcagcattttttgacagcagctctagcaaatgaatgcagtgcttcgggagtttcgggaagctttcttaagtgctctatcgtttaactcaaaaagatccctgtgaagttgagggtcttagcatttcacagatgaggaaatgaagactctgaacatctgaatgacttgttcttgttcagactaattcagccagctggaggtagacccagagttcaattaaactcttcgatgtgaagtctggatccaggaaagtaaatgtaagtgctctaacatcttccagcttcccgatatattcagggtttaatgttttttgaaagctttgagctctccagatattgttcaagtcaaccctctcccatgcaccaacctgcctctgagaaactgattcctttttagggagagaaaaaattgcctttctttttgtgctataaatgtcccccagggcactgctttagctgcatcccacaaattttcctgttttgtagttttgtttttgactattttggtgtatttaaaaagtttttcctttagacttcctcttggacccatgggctatttagaagcatgttgtttactttcctggtgtttggagattttgctgtgattcatttggaatttgattctattgtggtcagtgaacacactgtatgattttagctctgttaaattcgttgaggtttgcctgggatatcgtctatattgggatgtgccccatgggtattctgctgttgttgggcagagtgttctgtaaatgtctatcagatcctgtttatagatggtaatgttgagttcttttataatttgctgattttctgtctagttgttttgtcaatttttgagagaagtgtgttaaaatctccaaccataattgtggatttgtctatttccccttccagttttattagagttgtttgttattgagacaggatctggttctgttgcccaggctggagtgcagtaggataatcacagctcactgcagtctcaacctcccaggctccggtgatcctcccacttcagcctcccaagtagctgggaccacaggcacacaccaccacacccggctgatttttatatttttttgtagatatggggttttgccatgttgcccaggctggtcttgaactcatgagccaaagcaatctgccggcctcagtcttccaaagtgctggggtaacaggcatgagtcactgcacctagccctccagttttatgagtttttgcttcacatattttgcagttctgtggtttggtgtatacgcatttaagattgctatgttttcttggtggaatgaccctttatcatacacagttttgttgttgaaatgaattttaaagatttttatgcaggtgatttttttttaaccagttacagttttcatgatatttggcgcctggcaacagaagagggtctccgtgaaaagagactcaactcagaggaggtagttttgctttctttagctattccagaccgagactgaggaagaggaaggacagcctgcacctccctctgcccctcaccatggaaaagggacaaagctaccagtgaacattctcatccacttggagatgccgatataacagaagcacaaatggggctggaggttttgataagaaacttgtaactccttaaagaggtgtttgatgaattgtttattctgcctctgacatagactcatatttaacaagcagtggcagctcatggctgatattgaaacaaggtccttagttttttcttagttaaatggcatttctttaaatcctggtctacattatggcttttcctgagtgtgtattccagtatagtaattcatggctggtgatgttaactaagagcttatctttagggagaagcatgatgcagtaagctcccaatccgtgcctgtggagtgaatggatgaaccaattcagttgggttctggggacaatctaggtctgtgatagttactgggatggtggctgaggtctcaggagcaagtgactcacttttaacaagtagctcacaagacccacaggtaggacaggaccagggaaagccactggctctgcagaggaagacggcaggccactgagctgccgctcaaagtaggagttcaccaggtggctctggaaagcaagtcgtagcaggctgggggcacagcatgggcaagagcacggaggcacagaaatacttcccctgctcagggacctagaaagagggtctgtaggccgggcgcagtggctctcgcctgtaatcccagcactttgggaggccgaggcaggtggatcagttgaggtcaggagttcgagagaagcctggccaacatggtaaaaccccgtctctactaaaaatacaaaaattaaccgggtgtggtggtgcacgcctgtgatcccagctactcaggaggctgagtcaggagaattgattgaacctgggaggcggaggtttcagtgagccgagatagtgtcactgcattccagcctgggtgacaagagcaagactccatctcaaaaaaaaaaaaaagaaagaaaagaaagaaagatggtccatagtattcctggagtgtactgtaccacagggcgtttgtgcgtgtgctcatgtgcgtgtgcacgcaagtgtgtagatattcaggataaaaatgaggctgaaggttgaagagccgggatgtgccacacggctgccacctcagaggagggagctgtggggagggagacagcagaggctgcccttttgttcaagagcctaaagatgcttcctgaatgccagctcggctcctggagtccctgaggcagggcgcacttgctcccctgggtcatgcacaaatgcacttatgtgtgtacacagacacagacatgcacaggcagacagacagacagacagacacacacacacacacacacacacacacacacacatgggcctgccttgttcactggcgcagccctccccaggctctcacacggcctcctgcacactcctgcctgcaggcacacaggcaggcactcccgcgtgttccgagtgtgtgctcatgtatgcgtccttgccagcctgatgctgctggcctttgaggcccctcagtgccgccttgctcctggaccccgttttagctggctgcctggggctaatcccttcccttgccccctcccccggctcttggccctgtgtaccctccagagtgtgggtgagagggtcctggtgaggcaggcctgctgggggagggagggaggcactctgccccatacctgggccacgggcattcagtgctggttgctggccctagcagtcgagtcctcacggggaggcccacctctggaccagtcacccagggcaaacaggacgtgaccatctgacttggccacaggctgacagaccccttgaggctattctctctcaggatctgtttgtgcagacagcctcagagctgcagggcccagcctctcatgttacctgcattggggagcaaatgattttcacatgtatatgaaatgcagaggctagtgtacgtgtgtgtgtatgcatgtatgtgtgttggccgctcactcctcacccagccccttaggaggttgctgaagaagaaagggccagagccttccagaaccccttggagcagcctacatgcctgcgtgtgtgctcccgggaggggtgtggagagaagaggcaaccgcacctggagccactatagatgtggcgcggcaggggagctcggcatcagaaattgctcaagtacacttgagaatgtacttgaattgtacagaattgtacaactgaattgtacttgaatgtacagaattgctccacttgggtggaggtgtgtagtgtgcaaggccatccctgtgagatgctaggtgggcagctgggctcccagctctggagcttggctagaagtctggctggtagggagcgggcaggcctcggggagggcgccccaggctgagcagctggcttccttcctggcagtcccagcctcccgggcctcttgcccgccccttgaggcccctggctgccgccctcgctgccccagccccggccacactggccctttgcacggtgttgacacacattccatcgcctctgcttaccgccttgctttccatgtgggcagatgcctgcggcgatggctgtctgggcctgtcctctccctgggaccctacttcctgcatggcgatcttgcaaatacctcccacccacactgactttgacctggcccagtgggggcccagggggctgattcctggagtttcgggcacccctatgagtccccaggctgagagggccaacctccagccctggctggtgtagacaagggtccaggttctgaacccgggtttgctgcctggaaggccctgtccctgcttaaggcagatggaggtgcctctctcaggaggccccaggcctcggggccacattaaggggagtggagaggagagagggctgtgtgaggaccgccggcggggccggtgtgccctgtcatcctctctaggttgggcatgtgtttgcaattctttacagtaaaaaactgaaaacatgctggaagggagattgatctcctgacaggatcatgggcttgtcaaggtcgtcttcacttgctctaggcgtcgcgctcttcagctgaccgcgctgctgcctccaccaccaatgtgtccacacacgcggtgccaacaatggtgcacacggtggcccctgctcccccatttctaggcttgtgtgggacccgcagcccactgcacacggcccttcctcctgcggtggaagtggggtgcactcccaggggcccccggcctaaggggctcactccccagcctccattcaggttggccgctcatgctctctggaaatgagccaaggacaacgggagctgccttcccaaggtcgccccagcccccaccaggttactggacgatgcgggtgcaaaggtccccccgccccccgcctccacggcccaggaggactctgggctcagctcattccctcgtgtcggagtggcctgggctgccgcagcaaatgaccacaaaccgcttggcttcagccaacaggaattgactctcccagttctggaggccggagtccagaatcgagtgcttcctccggtggctctgggggcggatccacccacctcttccagcttctgggggccctgggcactccccaccttcgcctccacatggccttctctgtgtctctctctcttgtcccttctaaggaaactgtccttggatttggggccccctggatcatctgggttgctctcatctccacatcctcaatttaatgacatctgcagacaccctttatttgcatataaggccctgatcacagggcctgggtgttaagatatggatgtatctttcagtgggggcacaaaccagtcaccccacaacgtctcaacagcccaggccccagccacagcgccccggtgaaggggcaagcttgggcaccaggacacacagccgaaggccactgggcacctccctgcctctgcttgaggaaaggggctccgaagctgtccctgcactgggccccctgggggccctgctccctgcagccggaggttccctgagcggcatccccgcccttcccctaagccctgggtggacggctttcgtcctgggagcacaggcctgctgagggctccttgctgtgggccaagtgctcctggccagggcccagggtctctgaagaaaagaaacccctgagctctggtttctcaggggccaagggggcacctaactcatgctcagctcccagcagccagggctgggtgggcaaggctgggacatgggagcgctgaaccctcggtatattaaggggacaccggtgcctggtgaatgcaaagccctaacgtccctgtcctccagatcaggacgcttaaactcattgaacctcctttttcaactagatgccagtgtgggaaaggcctctgcccccaggatcccgcagccagcctggccagctgagccagcctaaggcagaggagggtcccccaactctccttccacctccttcagaccatgtggctccacagttggccctggggggaggtgctgccttggctcccgccctgccgtgaaggtggctcacagccccctttggcctggtcttttcccactggctcagtcctttgggggactcgctcacttcccatggacagcttggcttcaccctggacttccctgctgggcctctgggggcctgctgctgacctgtccccaggagggagctgcctctggcctggcaggtgcccccagcacagcgggcaggaccacagctgtgggacggcgcttgctcccctgtgccccggctacctcgcctgcccatcgtgggccagcctgggacaagaggagaacgggagactggagctggggggcagccaggccagccagactgggagggggtggccgggacccagggaggagaggggaactccccgctcccagaccccccgactcttcctccccagcccctcctcacccaccttcacactccagctctttctcctcccttggctctgccaggggctgtctcaccccctggactgctgacctgccgggcagtggccgctttgcaagtggcttctgggccaatgcccggaggggtggcgcgagaagactgaccaagaggaagagatttggctccagggcagtgagtggaaggctctttcccccgggtaccccgtctacccttcaaagagggggagggtacgccagccatgcctcaacaacagtcgtccatttcagaggctgcccagaccaccctctgctccctgcaggaaatactgaacctcttcattcattcattcattcattcaacacatattgaagcacctgtgctggtgatagaagagtggactcgaccaagtgtctgtcgccatgactttgatatcctagctggggagtcggaaggttacctgaatgaaggtcaggttattccaagccagggtgcacctgggcccaggcatcctctgagccccttagcacgagcatggctgtggcaggttcctgactcgccaacctcttgtcctctggcacctggaggaccctgggtggcagtgcctgtacagccgtgagacctccctggggtccagaaactgtggctactgggcttcatggtaagcccgggctcctaggcctgtgaggcgctggggctctggccagcctgtagccttcagtggggtgggtctgcacaatggagcctctgccatggccttcccttccctccttccttgcagttaacctacatttggtgtctcctggctttgcccttcatttctcctgctcacggtgccagcctctgagaacaggctgctgggccgtcccagtccctcctgcccctcccccttacttgaagccagaggtcatggagctgaagcaccaggccatggaggagggtcatgggagagagaagggaactgtccaaagggggtgaaggagaagggggggacacctggttggggcaggtgactgtcaagaagactttccagaagtctggctaggaggcacggtcctgtgagcaagagggtgtagctggagggggctccagtctgcctgtccctcccccaccttggctgtgtccccagccttcctcccggtggcccagcccagcccggccctcgcagtcagtgagttcctcctgagccagttctgacagggacctgtcctccaggtcagggggtgttccatgtggcttggttctgtggggtccagtctgcccagccagcggccctggggcttgactgtggttggcggcccttgatccacggcacccaccacttgtgtgtttcaaggggctttttctcaccaaatgagtgtcccatggttgccataagaaatgactatggaccctgaggcttcaaacagcagcaatctcttccctcacagctctggaagccagaagtctgagatccaggtgtgcgcagggccgagtctctaggggggatccttcctgcttcttccagctcctgggggctccaggcttcctcaatttctgcctccatctccacacggccttctcctctctgtctctcctgtgtctcagaaggatgcctgtcattagatttggcaccccctgccccccgtcatgtaggcttactgtcatcacatctgcagataccctctttcctaaaagggtcccactcacaggctccagaatgtggacacatcttttggggaccagcacaccccgacaggcaccccatttctgaggacagcagcaggtgggtgctgacggggcggctgctctctgctgaagtgtgaaagggctaaaccctgcagtagggacccctccctcctcctggcccagccgccaaagccacacgctctgtcgcccttgcctgctctggctctggagagctgagggcccttctgggggcccagatgtgtccgtggctgagctcgggtacaggttggtgcctgaggtgtccctgtttgtgactgagaggagtgggcgttggagaggccaagtccttgacctaacctagccagaggggaagggccggtgtccttgcagaggggctgacctcaggagggagcaaacacagggggcaaggacaggccatctggagggctggcaggaagcagagtggtggggggcggtgggtccagtggtgtcagggagctctggggcccgaaggatgtaggggcaggagtgtgccaagacaagggtccgcccacgtcttgggggcctcctcgaaggcttccatcagtcccatcccccaaacctttgctgttctaccccttcctatccccatgcttggaaattatgcggccacataaatgctgctcacggtggggccatgcgagctgcattttgttttcccaggagttaatcattgtcctttgggtagctgtttgctcgtatcacgaactcaaccctagaccccatccgtgtgtggaaatgttctctcaagatgtccaaacacagccggcatttgagtgatttcatcttgcagaaaccctctcacagcagagcctctaacctccccaggctgtctgcctcgcccctgcccctaggcgaagctggcatcctgggtctccctctgcccttcccccctcctatgttgcagccctcagtttatggtcacttttcctttaaaagtaatgtcctgcttgtgtaaagttaaaaacacacattgagaaagagctagacggaatctcagtagccttgactgttccgcgtgaccttgagcaatcatctccccttgcgggatctcgctcgcattatctctggaaggacagagttggactgcagtcattcatgaatgcttcacttattcaccagacactcatttcgtggtgactcttaagaaatggtttatcatggaaaagttcaaacataaacaaagacagagttcatgaaaccctgtggatccatcagctggcatcaacagttcgcccacatttttcatttatacttttcttttttctgccggaatattttttaacttgttctttttaaactgttagattcacgaggacgttggtaagaagtgcctgggaggctgtggcccctccccacaggtccctctgacattggctacttgaacgcccgaggcacaaccggaacctggacgcgacatcgatgctcgggtgtctcctgtgtgcgcacactcgtgtatgtgcgtctctatgcaacttcatcactgtgtacattcatggaactgccagtgcaatcaaattacagagcggtttcctcaccactctgctaccccgtgctacccctttatagatgtgtgtttttgtaagaaactgccaactgctttcccgagtggctgcccggtttgacatatccactagcgatgggtgagcgctggtttctccacacacccactccggcatctgctgtggtttagttcagccatgggataggtgtgtgatgcaccgcactgcggttttgatttgtgtctccctaacagctggtgatgctgagccccttttcgtgtacctcttgacgacggtaagactgatcagcagattcagatggtgtcggcctgatctggcctttatagaattctctagtatccttttgcccagtgtttttatcacctagatccattatttagggttaaaaatggtgatttttcgattcgattctataattcttcctgcatttcctagttggaattcggtaacagaagagctttccctcatcgactgtttggtcaccataaaaaacaggtggggcaggaatagccagatagccatgtgagtcttctttctatacatcacccttcagagtcacaagccagtccccaacaacttctgcaagtgacccacaattaagaatattctgactctgggctgggcatggtggctcacatctataatcccagcactttgggaggccgaggtgggcagatcatttgaggtcaggagttcgagaccagcctgaccaacgtggtgaaaccctgtccctactaaaaatagaaaaaaattagccaggcatggtggtgcacgcctgtagtcccagctacttgggaggctgaggcaggagaatcgcttgaacctgggaggtggaggttgcagtgagcggagatcaacgccgctgcactccagcctgggtgacagagcaagactgtgtttcaaaaaaaacacatatatcccaccaggtgtgtacaataaaaatactgcttttcctgtcttgtctttttcttttcttttctttcttttcctttcctttcctttcctttcttttcttttcctttcctttcttttctttccttttcttttcttttttttttttttctgagacggagtcttgctctgtcgcctaggctggagtgcagtggtgcaatcttggctcaccacaacctctgcctcccaggttcaggcgattttcctgcctcagcctcctgagtaaatgggattacaggtgtgagccaccacgtccggtcaaccaaaatactgtgtttcaagacacttgaaatacttctatatatgattatgccgccaacttttatatggtttggttcatctgtttctgtttgtttgattcttagggatggcagtgatctttctttttgattttttatattatggaaaacttttttcattaaacaatatatgtgtattcatatccccacatttttatacaaaaaatggcatattgtcgtgtgcctcactgttgggtgtatcttggtatgctggggtgcccagggcagcatgctgactctagttgcatagtattccaacacgcaggtcagccccagcttgttcaaacaggcccagctgatggatggtggcgtcgtttccagtactttgctattacaaataatcacccattcttgttaggtctgtaggactccttccctccctccctctcccccattcgtttgcatatatatatacacatatgtatatacatatatatacacacacatatatacatatatacacacacatatatacatatatacacacacatatatacatatatacatatatacacacatatatacatatatacatatatacacacatatatacatatatacatatatacacatatacatatatacacatatatacatatatacacatatatacatatatacatatatacacacatatatacatatatacatatattcacacatatatacatatatacacatatatacatatatacacatatatacatatatacatatatacacatatatatacatatatacatatatacacacatatatacatatatacacatatatatacatatatacacatatatacatatatacatatatacacatatatatatacatatatacatatgtatgtgtgtgtgtgtgtgtatgggtatatatatatatatttggtcatctgtgtagctgaatctcatcctaactgatagaagagagaaccatgcagatggtggtgggggggtggttccttttagacttctcattctgcaagtgttgggccttgtcttctgtccccacaatccatgaggccatgaaaactgaagcccaaagtcaccagggtctgcaaatgcccgagggtgacagttagcctcactgttctggttacctctcggagttcctgctttgacttaatttttggactctgggaattccttacttctctgccatatcattggtgcatttagaaaaatgattttaaggccaggcacagtggctaatgcctataatgccagcactttgggaggccgaggcaggaggatcacttgagcccaggagttcgagaccagcctaggcaacagagtgagaccccccgtctctataaaaaattagccaggcatggtggcacctgtagtctcagctactcggaaggtgggaccataaaaggtgttgtcatcatcgtcaggatgaactgcaaatgtcgaccactacctcttcatcaccaggcctcaaggagaattgctcatttctaagcctggcatgagggggaggggaaaatacctcctcttgagtatttgtactcacaaaccagcagcacatggctttgcagctgggatttacaacacccagataggccattaactcctcaaactgagaatttagtttaaaatacttctgggccaggtgtggtggctcatacctgtaatccctccactttaggaggccaagatgggaggatcactagagctcaggggttcaagactagcctggacaatatagagagaccccccccccccaatctgtacaaaaaaaaaaaaaaaagctgggtgtggtggcatctgtggttccagctactcaggaggttgaggcaggaggatcacttgagctcaggagttggaggctgcaatgagccatgattgcgccattgcactccagcctgggtgacagagtgagaccctgtctcaaaaaaaaaaaaaaaaaaaaaaaaaaggttctgggttaaagtgccccggaaaactgtcagaaggcaatgcaaatcctctctggagggacccaccttcaaccaggtctcaaggcattcccactctgaagacctgagaaggaaaaacatccagtaaaaaaatccaaacacacgagtgaaacaggaaagcgctccatgggtgagtgccagcagagcacagctcccacagccaacgctgggattatcagctacagagcataacgtcagtgtgtttaatacattgggagaaatcgaagagggggttgaaaatatcaaaaaggcagcattctatgaaacaaccaaggatatatgaaaatgaaccaaattatacttttaaaagtggaaaataaggtagttgaatttaagaattcagtgaaggacttcctcttgtgatcatgataaattagtgaattcatgcctccgtcctactgagggcaattagaaaagctggaaaaatataaaagtcacctgcttgaaggcatcatagagcaaaaagaggatgaagaacttccagggcaggatgctagggaggcgaggccagtgtttgcagctgctcacgccctgagggtgattggagattgagaacaaggggagtacaaactgtccagggcttttgacagctcctggggctatcaggacaggcacgggaaccaggaccctgctcatggagcaccctggtgcatctctctcatttcggtggggaccctgtagggctgttctctaggagtaaaggtgatccagcaatggaaagtctcctagtacttcagctagctttttagcctctcaatacccaaaactggattagggcaactaatcttagattgctggcatcctcagaagctgggacagccaagtggcatcttctctggaggaaggtgacattgccctcgtccttaagttatcactataaaaatgtttgcaattgaaatgttcagcaaacaataaaaataactaggcatatgaagagtgaaggcaatatgaatgaaagcagcagaaatagacccatagtggaattatcaaatacaaactttaggataacctacgggaatcaagactgcatggtattgacataagaaaaggctcatagatccatggaatagaattgagaagccagaaataaacccacacatcaatggtcaattgatttttgccaagtgcaccaagaccattcaatgggagaaagaatcatctctttaacaaacggtgctggggtaactaaacatccacatgccaaagaatgaagctgaactccagcttcacaccatacagaaaaagtcactcaaaatggattaaagactcacatgcaagccccaaaactatgaaactcttagaagaaaacgtaggtgtaagtcttcatgaccttagatcaggcaatagtttcttaaacgtgatacacaaagcccaagtgacaaaagataaaatagatacattggacttcatcaaaattgaacagttctgtgctgcaaatgttactatcaagaaagtgaaaagacaactcgcagaatgaaatagaagatttgcaaattatatatcagataagggacttgtatctagaatatatcaagaacctcacaaaaacccacaataaaaagacaaatgacccaatttttaaagtgagtggaggatttgaatagatatttctccaaataagatgtgcgagaggcgaatgagcacaggaaaagatgctcgacatcaccagtcatcagagaaatgcaaatcaaagccacatgagataccacttcacactaagatggctctgttcaaaaggacggacaccgacaagtgtttcccaggcgtggtggctcatacctgcaatcctagactttgggaggccaaggtgggcccatccctgagcccacgagctcaagaccagcctgggcaaatggtgaaaccccatttctacaaaaaatacaagaaaatttagccaggtgtggtggtgcacgcctgtggtcccagctactgtggaggctgaggtgggaggatcatgagcccaggaggtggaggctgcagtgagccatgatcgtgccactgcactccagcctgggtaacacagtgagacaccatctctacaaaaagttaaaaaaaatttagccaggcatgtagttgtgcacctgtggtcccagctactggggaggctgaggtgggagggttgcttgagcctgggaggttgacactgcagtgagctatgatcatgccactgtactccagcctgggtgacagagcaagacactgtctcaaaaaaaaaaaatactataatctacagaccttagagtttattgattgtgccaataatatcttttctataatgttctttccagaaaaggagcacctctgatcacacgttctatgcagttgacctagctctttagtctccttaagtctggaccagctctttgttcttcgtggttttcgacagttttcaggagcatatgggccagtgattttgcagcatttctgtgtgttggggcttggctgatgtttcctcatgattccatccaggttttgcactttccatgggaatagctcagaagtgctgcttccctctctgtgtatggcatcaggaggccacgacaccagtccccttgtcccattgctgatgatgatcactttgatcatgtggttaaggtggcatcttccagatgtctctactgtccagttcccatgagttttttcatccattgattattttttgcttgaaactcattactacaatagttgccaaatggcgatttcctatttccatcattccttcttcatttattatttggctttcttctgtgagaaagagcttctcttctccccctttacaatcgtgtgttgcttaatgatggggctatgttatgagaagagtgttgttaggtgattacatcattgtgcgaacatcctagagcgcacatacgcaaacctagatggtgtagcttactgcactcccaggctatatggtatggcctattgctcctgggctacaaacctgtacactatgataatgtaggcagctgttaacacagtggtaagtatttgtgtgtctaaacctagaaaaggtccagtcaaaatgcagtattataggctgggcacggtggctcacacctgtagtctcagcactttgggaggctgaggcgggaggatcacttgatcctagaaattcaagaacatcctgaccaacatagtgagacccaatctctacaaaaaagtttaaaaatagccaggtgtggtggcaggtgccagctactagggaggctgacatgggaggattggttgagcctgggaggtctaggctgcagtgagctgaggtcacgccactgcactccagtctgggcaacagagtgagaccccatctcaaaaagaaaaaaaaagtgcagtattataatctcgtgggaacactgtcatatgtgcagtttgtttttgaccaaagtgtcattattcagtgtacaactctacttatttctttttatcactgtggactcgggggtttcttactttctggaagaacagggtgttctaggctcatcttgactttccctggtctccttttctggaatcagccatttctcctaggatccctaattcattttgagtggataatgacacttagaagcttactgggaaattgcacacacatagagaatacatacatatatgtgtatatatgtatatacagtcccatatctatctatctctctctctgtctctctctctatatatatccatctatctatctaccatgagttcatactgacccatccaatttcaacccaacagcaccacgtcccttctagtcttcctcctacttgctggttggtaacttctttccctcttgctgagaaagttggctcccattacctgaaatatatttatgtatttgctcagtcctagaatacttggaaagtagtttcagaatcatcaactcatgtctctggaaaggagaaaactactctgcagatttccaggtttgtctagagttatttttgtttttcactcgaggacatatagtcccataccgtgttcaggttgcttgccgagtttttttctctttcaaggtggttgtgttattgttcgatatatggtttgcttcacttgtttccgtttgtatttcctgtgaggatctatttccccacccttgtgacttgatctgttttaggtactttgaagttcaaatgctctctgtcttctgattatgacgaggacatgggttttgggtgggtttatttgtgcttgctttttaaaagtgattttggtttggaagctctgttgagagttccagatttaaggggctgccattaccttggatatccaggattttctgaaaaatcaatgttttgagcatgccagttctttccaatttaagttttagattgaacgtaattgtaatctaaatgccatttgtaaacggagcttgacaaggtggttcttaaatctatatggaagaacaaatggcacagctaagacagagagaaggaggaggtgggtggagttgcctcggcagattctaagaattattataaaggtgccatatttaagatagtgcgggctgggcacagtggctcatgcctggaatcccagcactttgcgaggctgaagaggaggatcacttgagcccaggagtttgagaccagcctgggcaacacatggtgagaccctgtctctacaaaacgtacaaaaaattggccaggcatggtggcgggcatctgtagtcccagctactcagggggctaaggtgggaggaccacctgagcccgggaggtcgaggctgtggtgagctgagatcgcgccactgcactctagcttgggtgacagagtgataccctgtctcaaaacaaacaaacaaacaacaacaacaacaaaaaccttgatgtatgacaaagctggcattgctggccagtgggggaaggagatgttcaataaataatgctggacaattggttatccatatggaaaataaggtctgacgacatcaagtgttggcaaggctgtgaaaccgctagaaagcttgtatactacaggggggggcatatggattggtacaaccacttgagaaaacaatttttcattgcccagcaaagttgcaagtgtacatttctggtggcccagggattttcctctggatatgcccactagtgaaacttgtgctgggcatcaggactctggtaacagcccaaaaagtggaaacaattcccccttccaccaagcagatgatgcagagatcagttgtagtttaatcccacaacagaacagaatgcttgcgggaagaatggattacagctcttcgtctcgggaataccacattcagcggaaaggcaggttacagaataatacagacagtatgattccatttgtataaaattcaaaacaggcaaaactaaaaaatatattgtttggggatgcaaaggtggtgaaactataaagaaatacacaggagtggtatatgcaaaattccagaaggtcacctctgaagtgggggtaggggacatggggcaatgagaagggtcacccaaggtccttcaaagggaacgttacctttcttctaagctggtggtgagtacacagaggtttgttgtattgttctttacacttacacatattttgtaaatgtccttttgtgtctactcagtatctactagaccgttttaaaaggtgagagttctgctgaattccatatggagaggcaccgtgatccttttgtggctgagaaacctcaaaagtcttcattaggccctggtgacccccccaggtaacagatgaggggaaaaattgggtcccaggactggctctgactgctgccatctctggtcacaacagctggtacccactggtagggctgtgcctgcggctaagatgtcaaagtacttctgtacccgttggtaaattgcagctgcccccgaaccattctctcctttgggacccccccccctcctcaccccctgctcctcctgatccagaactagtggctcattctgggcatagcagtggcccttggagaacctgcaccagcccctcagcagcctctgtacctgggctaccctggtgttaagtgctggggacattcacactgtgcccttggggtcccagcacccacactttgggaggagagaagacttcaggtgacgtccacccaccagctccgtgtgcagccctgtccacccacagccagtttgcctcatggctaggtcacctccaagcctgaatttggaattcaaatgaaggagtttatttttaccttttattcaacagcggctgtagcttaatcagttctctaatgatcaattgttctggttttaagaaatcaagcactttgaaaccaattcactgaaggcccttctgtctttgcgaacggattgcttgtcagtcgggttaggggctacttcctctcctgggggctctttttcttctcctttcttctaaagtagatgatctggttgccagagccttttgcacagggttgcccatttgcccttgggctggcgttgccccctctggctccaggcgattgctccctgtgcccgcagctgtcgtgcccggctctgtgaggggaagagggaagcgaggcagtgtggccccacacttggctgcactgtgtgtttcactatgtttaatgcacaaagaaaaactgcatcaggacacacaaaatcagtccaaaatatcttttttttttttttttttccttagacgaagtctcactctgtcccccaggctggagtgcagtggtgtgatctcagctcactgcaacctccgcctcccgggttcaagcaattctcctgcctcagcctcctagagtagctaggattacaggcgtgtgcaaccacgcccggctaattttttgtatttttagtagagacggggtttcaccatgttggccaggctgctttcaaactcctgacctcgtgatccccgccgccttggcctcccaaagtgctgggattacaggcatgagccactgtgcacggccagtccaaaatatcttaataaagtatgcttatttctaggagaaaacgatcttaggaaaaggtctttatccaaaaggacaagaattctcttggtttcctcagctcaggggagaggcctgagtagagaaaacagaaaggacaagggcaagatgccccaaaggggtaagtgccctcctggctcgtcttggcctctggccccggcaagaatcacacacttccctcaggagaccagccttactcactcccacagaagcccggacggaagcaggctgcccttaggggaatgctgtgtttttaatccataaaatgccaaaaagctgggagaaaataaggccctgccagagctgtggacacagcccgcagtccccggaggctgtggggagagctgggtacgtccccctggggatggggggcacgctgtattcctgaggaggcacctgcctgtctgcctgctgaggtttctgaaggcaggacatttgctgagcctggcaggactgaaggcactcttaccccagctgccttctgccctgggggcacaaggtgtgggggccagaggtctgagggggtccggtagacgctggtggggcccagagaggacagcgcttcccaatcccagagggtctttagcctcagcaaggaaggggctgagcctgccctcagaaaagggcgaccccattggcaggcatcaaaaagcccaggcaaagatggggcccctctcaccccctcaccctggcacaagttctgcctgccccggcccgggggggtggggggtgggaagggagggaagggaggtcaggtcacctcctctccattccagtccattccagccccaaggatggggaggggaggcccatgggatgtgagtctgggctgaattttaataactgaaaaggaccagaaaagttaatgatcggggtgggggaggtgtcagaacacagtgactggcgtaaacaagccctgtcatgagttccaccaacaggaatggtctggaatggccggcacagccccaggaagtgctggaggggctgcagacccaggtgtgatcaccccgctaggctgtgttgcccaagctggggccaggcctccagggcgcctcctcaccctgtcccctccagatggggcagagcagggagcagccgagcaaggacatgcgtttgaggacaagtgggcagtacagacatttcccactcactgaggctaggaggctgggctgggagcgccccggggtgaacagaaagcactgggctgtgagggagtccttgagcagactgggtccaacaggaaggctgcagcggtggaaccccgagctcagccctgctagtgattttctaggctctgttgtgctgtgccagctccggacctgtcaggaagccaccctttgctctttctctggccagaagagaagaaggctctccagtcctgatggcctaggtccagcgcccaggccaagggcgcccccacagacaggtgctgactctagcatttgtccatctggcccgcgtagccgccctccggtgtctttagatccgtggccttttctccgtggtgggcgggtctccagggcagtctgtccccttcctcgcgtggcggcctgctgcacaccagcggcagcagcatcccgtcgcggcaaatggctgccgcgcaacaggctgcctggtggctgagcggaaaccatggcaacgggaagcagggaggatattcccgtcaccctctggaaagggcagcctatttctgggacccgagcccagttcttcactagttgtgtattttgctgtgaatttcgatgctggagacacggcgtggagggtgcggggctgaggcagggagggggagtgaccgccccccgccgcaaccccgggcccggaggagacccagctccgagctcagccccgccggatcagacccctctccagccacaccaggggagggcgggcgctttggggggcactggggcggggtctgcttcccagtcctcaacagaggggaccttttggagcgccttggccggggactgcctggggctcccagcagcagggggatggggtgggggtggcgagcttagttcgccggactcagcgtcaagcgagcccccgccgtgcgtgcacacgcgctcgcgcacctccccgcacgcgcacgctggagcggtgtggcttttggtgtagacggctctgccccctagcggcagctgcggtcagcatgcggggctccttccagggagggcttcggagaggaaggagaaggggtccagggagggaatcgcaggctgggcttggggcggaagatcccaggaggggctcgcggcggcccgctgccccggcagctccttttcacccgccaccctcgtcctgggtgacctcagtccctcttatgcctgtccagacctttcccttaggggacaacccccaggaagacataggcccctcaaactccacatgtcacaatggagcgcttctgcttcccacacccgttcctcatctcggagactggcaccttcacccacctggttggcccagacttgggagagctccttgatatctcctcttcctcctccccaacatccacctcctcactgatcctggggattctccatcccaaatagctttgaaataatccacttctggtaggcagaatttcggcccccatgaccttcatccccgtgtcacgcccgtgagtatgttacattacatggccaaagggactttgccgatgtgatttgggctactcatcagttgaccttaacatagggagaggagctcatacaagcagagcttcactggccaaggccagaagccgaagtcagaaagatgcagagatgatgggaagagctcttggcatcattgatggcgggaaggtgaaactagggcctatagctccaaggaactgaattctgccaacacctgaatgagcccagtccacctgacaccttcttttgttggtttgtctttattttgagttgtgatagattcacaggaagttctaaagacagtgcagggaggtcccatgtacccttcacccagtttccccatttaaagtatacatgccaggcatggtgcctcatgcctgtaatcccagcactttgagaggccatgatgggtgggtcacttgagtccaggagttcgagacctggcaaactgcctttacaaaaaaaattttaaagtgtacaatgcaatactttaaaaaatattcatagagttatgtcaccatcaccacgatctcattccagaacgttttcatcatccccaccaggaaccctgtatcaactaagcactaactcctcattctcctctccccctaagtcctggcaaccattcgtcttcctttctatggatttgcctgttccaatctgtcatagaaatggactcatataattttgtggccttttgtatctggcttctttggcttggcataatgtttccaaggttcaccaacactgcagcatggaccagtgtttcattgcttttgggggctgaataatgttccgttgcctggatatgccacattttgtttattcatctattgatggacatttgagttgtttctgctttttggctattatgaataaatctgctatgaacattcgtgcacatgatctggtgtgggcatatgctttcagttctcttggctgtatagctaggagtgaaattgctaggtcacatggttactctatgtttaacctttggaggaactgccagactgttttcccaaatggctataaccattgaacatcttactagcaatgtatgagggttctgatttctccacatcctctccaaacagacacttgttattttccattttaattttattatagtcatcctaacacgtgtgaattttatcttattcaagtttttttttttcttttttgagacagagcctcactctgtcgcccaggctggagtgcagtggcacaatctcagctcactgcaacctctgcctcccgggttcaagtgattctcctgcttcagcctcctgaatagctaggattacaggcacccaccaccacgtccggctaatttttgtatttttgggagacacggggtttcaccatgttggccaggctggtgttgaactcctgacctaaggtgatccacctgcctcagcctcccaaagtgctcggattacaggcatgagccactgtgcccagcctcattctagttttgatttgcattttctagtgatctgcatcactaatgactagtgatgttgaccattttttcatgtcctcatggcacattgtatatagtcttttgagaaatgtccatttagattctttacccaacttttttttcttttcaagcaaatgaatactttgattaacatggtaagttttaaaaaaaacatggtagggttttgacctcaaatatttatcaggtctgctacttaaatgaacttatagctggacaatgtatgaacattgaagatgcctcttccactccagtttagggtccaatgtacagttccacactctcatcccccagcccctcaagagtctttgcaaatctctttcattttatgccgagtccccgaaatgcatcagggtattacatcaacttgtacagaatatcaagatctcatcctctagttcaggttccatgtcagataaagctgaattaggttgtccaaacaaactcactagacaggttatatcagatagtgtaccacataaaatttaaattttgaacaaaatgtgtctctcctcctttggtcttacacagaaattaaagtcctcaaatacagataatactctccattctccagctcttctccagattcatgggtcccagccaggtcggcccatccacattcccagctgaagtctggtcctttcttcagtagttgctgtatggagtcatcttctagaatcattgcggctccttcagcccctccagagctggagaactccaacaatgaggctcatgtgtcacacacagatccaaagttccagggagctatcagatcacacaagaaagagcaaagcacctcaaacatttagaaataacaaccaaagcccaggaacaaatgtgactgctgcaagagcgtggtctaggccctcattcctgtatgagagagcattttccaaataaacttacttccccagacaaaaacacaaacaatcaaaactcatattgagttcatcaaccacagaccatagcagagaactgagtgtgagtgaggacagagcgtggacagagtaaaatagagaaaaccaaaggctctctggtttcagcttcttctgggtgtcagccaatctccaccagtttaccagaatccattggctgtaaaccaccgaccgtgctctcgactcgttcgtctctatcctctgggccagctccaccagcatctctgccatcttcaccatttccttggccttctcctcggccttctggcacctcttggtcaccctgccctccactgcgtcgcccgggttgtggaggcggttgaggatgctcctccgaagcctccacctgggttttgatctggaagagcatattgtccatctcccacagcgtgctccgcttccacaggtacgcccgccagtgcttgtcagcgacgcgatgtcctctggcatctcatggatgaccgggagcagaaactgctcaaaacccccctccagctccagcacctccacttcctccggttctgacagctcggcgacatccaggggccgcatctcttcctgctgcctcggaactgcagtagcaacatgagcagagcagcggtgaacaaaatccctttactggtgaacaaaatccctttacctaattttaatcgggctatttctttttgttattgagttgcattggttctttatatgatctagatacaagtcaattatcagctactgtgtaatttgcaaacaggctctgttactttgggggtcgccttgtcactttctcgatggtgccctttgaagcacaacagtttttcattttccaatttagttttttctttgcttgttggacactttggacatcctttctaagaaaccattgcctaagccaaggtcatcaagattgactcctgtgttttcttccaagagttttatagttttagctcttacatttagatctatgatccattttgagttaatttttgtatatggtctgagctaggggtccaagttcattcttttgcatgtggatatctaattgtcccaacaccgtttgttaaacagactattctttctgccattgaatggtcttggcactcttggcaaaaatcaattgatcatagatgtaagggtttatttctgaattcttaattctgttcaattgatgtataagtatctttgtgctagtaccacacagacttgagtcctgtagctttgtggtaagctttgaaattaggaaatgtgagtcttggaaaattaggaaaaataactttgttctttttcaagattgttttggctattctgagtttcttgcattttcatatgcattttaggatcagcttgtcaatgtctgcacaaaagccagctaggattttcttttctttcttttcttttcttttcttttcttttctttctttcttttttctttctttctttctttctttctttctttctttctttctttctttctttctttccttctttctttctttctttcctttctttctttctttcctttctttccttcttttctttctttcctttcctttctttctctctctctctctttctttctttcttctttatttttctttctttctttcttaatttaagccagctgggattttaataaggattccatttaacttgtagatcaattgagagagtattgtcatcttggtcgttggcaaagcccgagtcctgtcctctcactctcccgccggagagcatgagcttcaccactggctccaccttttccaccaactatcagtccctaggctctgtccaggcgcccagctacggcccctggctgttcagcagtgaggcaagcgtctatgcaggtgctgggggttctggttcctggatctccgtgtcctgctccaccagcttccagggtggcatggggtctggggcctggccacggggatggccgggggtctggcaggaatgggaggcatccagaacaagaaggagaccatgcaaagcctgaacgaccgcctggcctcctacctgggcagagtgaggagcctggagactgagaaccagaagctggagagcaaaatccgggagcatctggagaagaagggatcccaggtcagagactggagccattacttcaagaccatcgaggacctgagggctcagatctctgcaaatactgtggacaatgcccgcaccgttctgcagatcgacagtgcctgtcttgctgctgatgactttagagtcaagtatgagacagagctggccatgtgccagtctgtggagaacaacatccatgggctttgcaaggtcattgatgacaccaatgtcactcggctgcagctggagacagagatcgaggccctcaaggaggagctgctcttcatgaagaagaaccacgaagaggaagtaaaaggcctacaagcccagattgccagctctgagttgaccgtggaggtagaggccccaaatctcaggaccttgccaaaatcatggcagacatccgggcccaatatgacgagctggcttggaagaaaagagaggagctggacagtactggtctcagcagattgaggacagcaccagaggggttaccatgcagtgacagagcgagactccatctcaaaaacaaacaaacaaacaaacaaacaaaccctctgaactcagtgaatggaaccttatttggaaaaagcatctgtgcagatgtaattaagttaaggatctcgagatgagatcctcttggattagggccctaaatccaatgacaggtgtccttataagaaggaaagaagtcacaaacacagaggagaaggccacgtggattcacagagaatacagtggtgccgccacaagccaggggacacccagatcccccgggaactggaagaggcaagaaggagcctcccccagagcctgcagaggagggaacagggtcctgcagacacctggatcttaggcttctggcctccagagctgcaagagagtgcatttctgttgtattactttgttatggcagccacaggaaagggtggggggaccatgaaaggaaacaaatacatcctcactttgatacttttgtacaaatacgccataggaaaataacacatttagggccccactaatgcatgacaattgagtaactcatgctatagacgggcctccttcttctctccctgataccttgacctctaccctccctcccttccttagccacttgctcctgatccccagatcctgtcagcatgttgtcatggatagagtggacctgtgtgacatgcgagggatggcgagatcaaggtccctggagacagactgtggcatggagccggagagctaaagcatcttagcgggaaggatagtaaaagcataatgttgctctttggggcaagtggaaacttctagagttctcgtgtatgagaatggaactgcaaatcatttgccagtggctttcctgctttgctccagcgagagggtcacagtgggaccagtggctgtgagtggagtccccatggggttgcaggacaggagcttccacaaggtgcctcctgctgcaggagccttcacccacccgagacggggagccagctgctcatcacaggaggggctcaggggctgcctaggagacagatttcgggcaaaggtgtttccatcagctcccactctggctgctgtgcgcccccacaatgaggatcccccatctccaaccatcgcagcggagccttgtttcagaggtgacctcgctgacctcgttgcaggactttgagggtacaccccactctggtcccctcccgcaccgcctccttgctatcaggagtcgtccctgggctatcggaggcccaggacagcccggccacccttgctgtggctgtcctgctgacgccctgggtttctcagctccttgcattcacttggcccttctgagagcttcctggctccgtaacattgcccgcttcttccagctgctctgccctccgactttctttgctggccagtctcccagctcttccttgtgaaaccccttctccccataagaagattttgtcctcagtggcccgattgcatgtggtagttttaaaaaataatggatttactcagatatcattcacataccataaaattcacccacttaaagcattcacagagttgtgccaccattgccactatctaattccagaacatccttgtcacccctgtctccatcagcagtcactccctgtgctccctccctggccctggcacccactcatctggtttcagtctcccacacatctattgctggggtggattttccggccctcatgcccaactggcaccacttctccttaggtccaacttggtcacacccaagatcccgtgcatgctcagagcttgctcaattactctactgagctcctggttactcaaatcgctgaaaaagaaaataataccaggcagaagattcaccaaaaagttacaatctgaccaggttttgtggctcacacctgtaattccagcactttgggaggccgaggtggccaaatcacctgaggtcaggagtttgagaccagcctggccaacatggtgaaaccccgtctctactaaaaatacaaaaaattagctgggtgtggtggcacacgcctggcctgtaatgccagctactcaggaggctgaggcaggagtatcacctgaacccgggaggtggaggttacagtgagccaagatcatgctactgcactccagcctgggcggcagagtgagaatctgtctcaataaataaataaataaataaataaataaataattgaatagaaagatgaagggtgggtaggcagtggggagcggggagggagaacagagatggaggctgtggatcttgccgatggtgacagggagctggctcggaaggtacagtggagaggtgactgtggcaggaggttcccaggcagcgaggagtttctaaggacaagtggcaggcctggactttgatgaggctgccaggatgaagaccagagcagggtgggtgctttggaaattgcccatgctttttgaagaccacacaggctttcaagtgaccctgcccgtgcacagcctctcttctggaccccaaatgcctcttccctctttctctgcctcatcctttgagcttcagcccgagtcctattccttgaaatgagtcactcactcttttccataatagtgctattgtgaggggtaggctgtgatttaatcaatgtatgggcacatggtgaggattagctaaggaagcgttggcaaatattacagaatcgcgcttctgatggtgactgtcaacctcagggtcgagcctggggttgagaaccaggcttcagccctcaaggaactcaccatctgagccggggtgatgagacgggggatgccacctttgggacactggggacaggcttgccagtgggagaggaggtgctgcctaaaggtttgctggctccagttggtggctagtgaattattcattcatcaaccactgcgccgaggtgacccagggctttaaaattcatgtgttcattgagtcattctctcggctcacattcccaggcaccttttacttgctgagcccggactcttttcagcacataaggcccagaggagaaggaggagttgtgcctagaggatgggcgggccaccaggggccagagggaagcactgtttgaattggggtgttcacatatgtgcacgtgtgcatgtgtgtatgtgggggggggatgtgtgatgcatgtgtgtgcgtgtgcatgggggtgtgtgttagtgtgcacagatgtggtggtgggggaagctgagaggcagcagcctgatcccccaaggcccatagctgctttagggaacatgggcttgagccttccagatctagctgtggctggtccagcccagggcactgtctgggggaacacaggacctggcctccaccaacggggctgaggggaggtgggccctctgggcattgcctaggtttcagccttgggctggggaagagggtggggctgctcacagcttgcagacagacacggtgctcaaggcgtggcaggtgtcagcagcacagggagctggggaccctgagtcagtccacacacgcacacatatgcacacacacgtgcacacccgcgcacatacagacaagagcaagctgggtgatggaagtggagtggtaattccttcaccaggcagaatacgtgcagagacgttcagccaggagaccataacctttgggggacctgccgaaggtctctgccatgaggcaaagtggtgagatccgaggctggtcagttgatagggtgactccacaaggaccagcatgtgaggtcaaggcctcacattttctcctgaaggtgaagggactccggagggtgttaggcagggcaggacctgttcagcctcgccttttagaaagctcgctctggcggctggtattgtggggtgaatgccagcccccaaaaggtgtgtccgtgtcctaatccctgttactgtgaccttatttagcagaagggcctttgcaagatgtaatgaaaataaggatgtcaagatgagctcctcctggattatctaggtaggccctaatccagtgacaggtgtgcttataagagacagacgagaagacagggagaaggccatgtagagacggaggcacagattggagtgatggggccacaagcccaggaagaactcaggctgcagaagctggaagagcaaggaagaactgatcctctgccagagcctttgagggagcaaagccctagtgtcacctccatttcaggtgtctggcctccagaattgagagaggatatacttctgctgtttttagcaacccaatttgtggtcatttgttacagcagccccaggaaactaacccagctgggatggagagaggacttggggaggctggtggaggcaggaagtgctgaggaaggagaatgaggccggactgggtgtgtggggtgggggtaagaggtggagacttccacaccatcaggagatcaaggcgcctgggcagaagggtttagggagcagtagctttttcctctccatattgccagctgtctgaaattgtagcaatgatctgaatgtatcagaatgactccagtgactgtcactaacttgggagtgagtacctttggggttctatgtccctaaagcctgatgcaccatttcctgcttgtggaagacgcgaatgaaaaatgagatggtaaatacctgagttcgatattcagcattcattcagcaaacatttattaggctcctactgtgcgtcgcgctggaaaggcaagcagaagctagattcccaatcgatcccgggaggctggacgatccagacacaaacaccgttcatgcgtctattcgaaaaggccctcttggaattttgtgcacagcatttccttggggtgtcgatggatcggggtctgcaaacattagcaccttttccggtggccgctgtcttctcagacctcagacaccggcgcctccccgtgaactcccgcaggcgtccctagcccagggcttggcgggcgctgccggttgtacctggcctaagccacgctgggccgacagcccggggcgacacccccttcggacggcggggatttgcggctcgggtgaccggaggtgccctcccgcgggtctcggagcagctccgcgggctctcgctccgcggggaggagcctgcgtctcccaggggcggggctcgaggcgcctaggggccggtggacacataccagccgccccgtggtgtcggcctctgcgcctgcgcctgcgcctgcgcgcgcggccaggcagcgtctgtggcgcaagcgcgcgctcacccttgggcgagggccctgaggggcggggcggggcggaggagcggcggggcggcgaggggcggggcggggcggcgaggggcggggcggggcggcgaggggcggggcggggcggggccggacgcggccgggtggggcggcacgcccgccgcgagcacctccagttctgccggcttctgcgcgccggggccgcctctccttccgccggtgccgcggcgcctcatggaagccccggaggcggcggaggggggcctgcagcgcggggcccggagggcagccggcgcccgaagccagggtgcacttccgagtggcgaggttcatcatggaggcaggtaaccgcggccgggggaggccaggacaggcggcgccgcggcccgcttcgcggagcgggcccggctggccaggccggccttctggagtgctcaccgtagcagaggccgggaagccctgctcggggctgaggacctccgcctttgcgccgcgcccggtgtgctgagcagtgagccgcgaggtatccccatggcgtggaccggtgtgcaggccctaggagaggacgtggccgggttgggcctccagcgaggcggagaccggcccgggcgcccgcagctctgcgcagtgcgccacgccttctgccggcacccgcggccctgcactccggtagactttatggcgcttagtcgcgcggagccttttggagaacgctgtccgagggttcctgtcactccggggacctaggctgcttgcagctcctgttccgaaccctgccaggacatccacagtagtgttgggctccgcgcttcccaggcgaggtgattaagctaagatctctgtagaaacatcgtttccatccagccatcaacagtatttttttttttttcgagacggagtctcgctctgttggccaggctggagtgcagtggcgtgatctcggctcactgcaacctccgtctcccggactaaagcaattatccttcctcacgcttccgagtagctggaattacaggtgtgtgccaccgtacccggctaatgtttgtatttttagtagagacggggtttcaccatgttggccaggctggtcttgaactcctggcctcaggtgatccagttgcctcgccctcccaaagtgctgggattacaggcgtgagctacctcgtccggcccatcaacagtatcttgataggagatactgttagttggcgggtagttatttcctacctttactgcttgggggagaagggttgggcagatgtgctttctacccaaggtgggcggagagtctgaggactgctgcaggactgttcatcccagtgatatgtaaatttactgtaatttgcaagaagagttgcaaagttattattagggaaggatggcagtgacacctcatctgctaccgtctgctcggagggtccgtgtaaattggggtttgctctgtaaaacaaagcttggaaggtcatgtcagtaacagcaccttatctggcatctcctggaatgaggggtcccaggtaggaattgtctttatataacaagtttagaccttctgagggacttctttataaaatgtattacacaatcctttgtcctttgtaggaggctaaatattgatttcccaaagatgtccctatcctaatccctggaacctgtgaatgtcatcttatatagcaaaagagattttgaagatgtgattagagaccttaagatgggagatcatcctagattatctgggtgtaaccacacccatccttataaggcaaaggcaggaggagtcaccgtcagagaaggccacgtgaggacagaagcagagttagaagctttgaagatggaggaaggggccagcaaccaaggaatgcagccctcctctagaagctggaaaaggcaaggaaacattctcccatggagcctccagaaggagccagccctgcttagacgttgatcttagctttctaggctagttttggacttctgacttccaggatcggaggagtataaatgtgtgttgtttaagtggctgaatttgtggtgatttgttgcagtagccctagggaactgatctaccttcttaggcagaggatgctgactgtcatttcatggttgattgtcggttgttcttcgcctttctgttttggcctagtggatgtcatttaaccttgtcttgtgaaccctggtggttgtgaatttgttttggttctgtgcaccagggcagtgattttcttaggagccattcagggatgggctggggatgggctttaacccctaagtagaatccactgaatcctgctctggtgttttgagttttgttcaccttaaaaatttttttctttctcttttttgtagagacagggtctcactctgttgcctaggctggtctcgaattcctgggctcaagcaatccttctgcctcagcctcccaaagtgctgggattacaggcgtaaaccagcatgcccagcccacttttcaatgtgctggtgtccttccctggtgcctggctgtggccataaacattgccttttctctgcaatgcaagtggttactcttggcagtcacgctgcttgctttgctcacctcttctaacctgtggactacgaaaccagtgctcagtgtaatctttcactgtgacttcaggacttgtggcacccacgaggccgtttcttttctgtcgtcgtagctgtggggtgggcgacttctagctagctgtttgctaaggtgaacccagacacacaacagcatatagtccttttccagggttttgcagaagctgctatgccagttgctaactgagcggtcctcggaacccttgtttcccagagcgtggtctatagacccctgacatgggcatgacctggggcttgtcagaagtggagaatctcagagccgcagacctacaaaaggggaagtctgcatttgaacaccatccccaggggcttgggtcacccactagagtctgagagcccagtaagagacccagcaggagccactggctctgctggaagttcttagccttgtccaagtagggttgtacctgctagggcccattccaatggctcccctcactggagcagtgagccagcgctggattgaagtcctctcttgcctgctttctctccgcaggtgtcaagctagggatgcggtccattcccattgccactgcttgcaccatttaccataagttcttttgcgagaccaacctggacgcctatgacccttacctgattgccatgtcttcaatttacttggccggcaaagtggaagagcagcacctgcggactcgtgacatcatcaatgtgtccaacaggtaatggcatttggctgggctcctgatctccacccggtgggggggacgggcagggaaggctcctatggggccctgcccaccaggtgccagcaatggagcttggaaggaagtacctggatggccttgaaccaggcagggccagaaacagtagcagcaaacgtgagaaggagcctgatgtcagaggccagtggggtctgtgagagaaacgctgggccagattatggggagcctcgaaagctggatggagggcagaggcggggcttcagcagagggagcttggagaggcatgtcaaagaagattctgtggaagtcttagacagggatggctgcaggcagaagagcttgcctgcagcgggagggtgcagacccagccaggtggtaggtcccagttgcttaggagcctcgccctgctgtgggtgtggcgtgggcatggcacagccggcccaagcaggtgtgttcctgctggggcagaatgcagggtcttcgccaaggcgagggaaagacggtctgggaaatacaaaactgagaaatgttcactttttggagtatatcattcccatgagaggcttaaacatgttccttggatggctggacgtggtggctcacgcctgtgatcccagcactttgggaggccgaggcgggtggatcgcttgagcccaggagttcaagaccagcctggtcaacatggtgaaacctcgtctctaccaaaaatacaaaaattagccgggcgtggtggcgcatgcctgtggttccagctgctcgggtagctgaggcgggaggatcgcttgagcccaggaggtcaaggctgcagtgagctgtggctgcaccactgtactccagcctgaaaggcagagcaagaccctgtctcaaaaagtaaaaagtaaaaataagttaaaaaaatacgttccttgggcccagagtgagagccccgggcattgccacctcaggtgatgaagactccctaatgccgggctgagtataacaggaagcacaaccgacttggcatgctcaagcttccggttcctctggagccatcgccaacagccagtctttgcacttgacattttgctgaatgatagcggacagcccatctggctaaaactaggagctggcttctttcctctgttggttactgttttcattctctacactagatgtggagatgaagaatttttgtataaaaacccaaataaaatgaccctccatgaatctgcagatggacgatgtagtttgcatctggacattgtgtgacttaagcaatttgagccatccagtgctcaggagactgccctggctgctgaagcattgccatttctctgcgcaggtactttaacccaagcggtgagcccctggaattggactcccgcttctgggaactccgggacagcatcgtgcagtgtgagcttctcatgctgagagttctgcgcttccaggtctccttccagcatccacacaaggtacatactggggaactggtgcctgtttggagaggctcaagccatggtctctgttctttatcccaaaagtgcatcccatctcatactcgagagcacagcacagaaggagagcagggctgcggctgggaactgggtctcctggctctgtgtttgtggctgggttggccgcccggcctctcccgtcccacccctgtgggttttctcagccaattctcatttcagcttctgcctttctgcctgctcacctgtgggcggggtccgtgctgcccgctgaagctgtggcagctcctgtggtccatatagatggtgtgcacgctgggcctcggggaagcaggctggttttgtgaccggccagagtccccgtccccaggggatgctgtgatgcctcggagcacgcctccagctcagctgtgcttaggaagccatggggaaagccaaatcgcttgagtcaagcagcatgctttaacttctaggaatgtgtgagtctcaacagaagaaccatttcaaacagcagtaaaagggaaaagtggaacgcttaggcgactggcacacgatgctctgggcaccgcagctccatgcacgggcagctcagaaggctggccggagacagagatggaggagttgtggtttggggctctgggctaggagtttcattctttttcatcggaactcttcctgagatcattgtagattcccatgcagttgtgacatgtacccttagcccagtctcccccaggggtaacacagccaggatgccaaaaccaacacagtccactggcatcctcacttccacttgtattcctgtgtgtatatttttctgttccattttatcacgactccgttcacggacctaccaccacagccaaggtgagagacggttccacccgcatgggcccttcgtgttgcctttataatcttgcctccagccttccacactcccacctcagtacctggaaagccctggtctgggatttctgcgcagtagtgtcttagtgggcagaatgcttgctgagcatcctgggggaaggtgggagatgccctggtggctgcagggtggagttgtcaaggcgacagggcttaggaaagagcagcactcagacctcaaggggtgtgtgatctgtgcccagatggggaactgatagcttggtgtggctgggagcctgccagccccttcccctccttccagtcagggctggggtggaaagtaacctatgtatccctcctgcatggtgtgctggggtcacacgcatgtgtgttccagactgtccagagagctcgcagcatctgtcttattgtgtgaggttctggcaaaatgtcagtgttctgagagcaggagctggcagctgggctgggaggtcatttggatgttgtggccgaggacagcatgtgcccttggcagcaggccagatgcatggggagcagcaccttctgttctgcccatgaagagggtgctttccggagcaccaggccccgaggaatttcatggtggccagagcgggccctgtggtggagagggactgtggtgggggtggccctcgtaggtttccctagagctgggtctggagggtgagagtgggcaggtgcatacggtgagctggtttcaggcagagggctcagcaagtgcgaaggccctagatggggtttgctggaaggcagggtgggatcggcaggagatggggccagcagaaggccttggggcttcttcctgagggacatggaagctgctggagggttggagcaggtgctgatatgattatgtcagcatgaggagagcagctggtgggcctaaaggctgacacacgtgtctttgcagtacctgctccactacctggtttccctccagaactggctgaaccgccacagctggcagcggacccctgttgccgtcaccgcctgggccctgctgcgggacagctaccatggggcgctgtgcctccgcttccaggcccagcacatcgccgtggcggtgctctacctggccctgcaggtctacggagttgaggtgcccgccgaggtcgaggctgagaagccgtggtggcaggtgaggtggctgcttggcacactggacgtgccccctttccctctggaagtctctgtattgcagtgctcaccaaattctattaattatccatgaagaaagatacgggctgctggggaacatggaagctcgaaagtaccctgttgcgatggcctgggacaggctctccccctcggcacagttgccatttaggggtcccggatgtcgaacaggagtgctggcctccaccgacgtcgccggtgtcccgggaggagggttgccccagcggagaaccgcttttactgaattgagtgggaacttgactgtgatcacaggttactaaacctggcttcccatcagaaacatctggggtgctttatggagagggctggatggctaggtaggtgacagctagctggctagttgacagacacctggatggataggggagagagctgatgggcagggtggcgggtgattgataggtattaataggtagatcatggagggtagatggtggaactctgtaggcctgtgcataggacagctttccaggtggctggtgctgttctgcatagaggtagccctgcctctcttccctggcccgtgtgccttgtggaagaccacagcatttgctgatttttgcgtgtttattgtgtaatctcgtatccccagtcagctgtgagtgcctgaggctgggcatctcttccccagtctcccgcgcctccctggcaccaaagcgggtgctcatgtgtctttgaacccatgcacccatgttcccagtctcaagccggaagcaccctgtccccaaggcagtgtgcaggtggtgcagggccatctgtgtagacagtgttgccccacgctcgggctgctcagggactttcacataatgtggctgcctcgtgctcagggttggactctggggggggcaaacaccctctggggacatctggtgggtgtggccctggccctgggctgcctggctatgctgcatctgtcttcctttctgctctgtcttctgcgcttgctcgtaaacctcacctggtgtggcagtaccacctgcgtcccatgctcagcccctcccagaggagtgcgagcccaggtaaccctgcacagccaggaagcagctctaccagcaagttgtttgctggcggcccagactcacccagtcatcgttcagactgggaagaagttaccctttgtggggtgtggaacttctgttcagccagctcttcttaaaggctctgctaaacttgacctgacctttgcctcccagctcggggctgtgcaccagaagcttccggaatccaggtgcctcctgtgggctggcggggtgcgagggcctgatcccccatgatgagtgagatcctgggaggcctcacccacccgggtgctgcagagctcacggcctggcttttgaaaccctttcttccttgtgtgctctcggctgccacttcttacggtgactcctgtcacttatctgccacgggctcagcatggcagcttgatgtgcttccctggagaagcctgcctgcactctgacttgccagatgagcagggacagtagcggggtcagaaatgatgcaggtcgtcacgcaatgctgctgaaacttccacgtccagagccacaccgagtgccctccatccccttgttcctgagcagaaggagaacctgcctctttccagccactgctgctttttgtcttataagcagatggactgccctcaaaaaggcagagtccccagaggccagcagtgtctcctcctaggacttgggtctgtgtctcttctgctgtcaggtgccccagggttgccacctgttctggactgttacatttaattgtggtgacatagacatcacctaaattgtaccacgttcaccatttttaagtgtgcggcccagggacggaagcacattcacggtgctgtgcagccatcaccaccatccagccgcagaaattgttcatcttcccaaactgaagctctggccccgttcaaccccaactccccacccccaagctcctggcacccaaccttccactgtcctctacagagttcacggctctcctttgaggcccctcacaggagtggaatcctacagtgcgggcctttctgtgactggcttcttttgctgagcacaatgttggagcccccgtctcagaatgtcctttcttttgatggctgaatcatatttcatggcctgcatggaccatatgatattaacatattcatccatcgatggatgcaggctgcttccacgttttggccttgcttttttttttttttttttttttttttaatagagacagagtctcactctattgcccaggctggagtacagtggcgcaatctcagcttactacagcctccacctccttggttcaagtgattgtcctgcctcagtctcctaagtaactgggattacaagtgcctgccaccacacctggctaatttttgtatttttagtagagacggggtttcaccatgttggccaggctgatcttgaactcgtgacctccagtgatccacccgcctcggcctcccaaagtgctgggattacaagcgtgagccactatgcccagcccctgaatgttttttaatgattgcttctgagcttggggtctccaggagcacacaggtcatggaccccagcaagcaagtgtgcatttctgaagtatttgtttttcacccagagcccagggtaagacagctatgcttcctgagtcaggacttggagggcgtccaggtcaccatctcctacctgaggttgtaggccacagaggaacctagggttctttgggagcattcagcaggggtggacgtaggtccagttcttgccttgacttggcccaaggccttgatctgattggtacattggttccccaggcagcaagctctggcacagggtggctacagacgcagcatctgaccaaggtcttgctgctttacttactatttcccttatcattggggatcccgaagagcaccctggggctcagtgctgtgccgggagggctcggaactcagaaaagctgtcacactcccagttccggtttattacaaggaaaggacacaggttaccgtgagcgaaggctcagggcgcacagggcgggctccaggagagaccaggcgtgagcttcagcggctcctcgcccaggggagttgtgcagacggcacctgtttctttcggcaacagtgtgggacagcgagcacggagtcacaaccgggaagctcatcccagccatggcggccagggtttccgtgggaggtggtgggctgcatgggcatggagcgcctgcgtggccaaccctggtcacttgggctgcagccaccagagatctggctgggactctgtggcccaaggccctcaccataaatgatgtggttagcacagaccgcctggcagtccagtaaaccaagacgctcacacggggcaggattttctaggggcctagaggttatcctccaggagccaggcagaggccagacctgcctttggaaggtacagggtgtggaccccagcctgtggcgtggccctgggctgcaaccctcctgccatgggccccgaggatgtccttcgccgtcttgcgagtgctcctgcacgtggcggtccggactgtggagtgggtccacatgctccccaggggctgggttagggtaggcgtggggtccgggtacttagcctgcctgtggctgcacagggactgccaccctctcctcttgccagtgtccgcagagaccctggacctgagggagtcccgggcaggaggcaggagcctgtgctctggacccagctgtgttaccaattccctgtatgacgttggacaggtcccctcctctctgagtcagaagatcaccaaggcctgttccatctggaatgttctcggccttgtaaagtgtttggcctcaacgggctggaattaaactggctttgcaggagagctactgtcttcctacatagccaagtccctgtgcccctcccctgcccatgaaatgtgattctctgcttagtgacaggtgccttgtttaacatagagggagtctaactggaacctgttttccttcttctttctaggtgtttaatgacgaccttaccaagccaatcattgataatattgtgtctgatctcattcagatttataccatggacacagagatcccctaaggtcctggcccaggcctgcccaaagagaagcccaggatggtcggctgcctggggacattgtcaccacgtcgccatgacggctggtccccacaggaccagctgggaggactggttgtgctgctggagaagggctggagaaggcaatggcatgctgccgctttgccagtccctagaagtcgcggtgcaggtgatggtgggagccgcgcctccagcgggcaggccgggagtgtactgtgtgcagctgacccaaggcagccacatctgcgtttgtcctttgagaggactttgactacaatacaggcatgacatcaatgaaaggaaagtcatgaaatcgatgagactgaatccctacggatttcttaaaagccagatttgtagggagaatgaatgtgcaacgtggctgaaatctattttgtgtaataaaaggtgatacaagtcaatagggacccttggctttgctctgcagcgcatgctgcacatgggggtgtgaggggccctcagagactggttccctcagagtgctctcaggtagagtgtgtcccagccatcaggcggcaggcctggggttagggaggatcacttgcattcagaaaagtgagtcctgatcgaacgtaactaaaagtaatgcgtttttaaatgtcaaggtagccagtctggatggggaggctggagaaactcagagctgtggcccccagcacccctctgactccttgctcaaaagccagtgggtaagaaatagaccagtccaggaggcgctctctaggtcccctttcaggctagacgtacgttcagcacgtggcgtagggccgggggactggtaggtttacacaggagggtgggctccggctcctgcaggtgtgggggcaggggtgatgcaggtcagggcagagtcttgcttgactttacagagcgactatgttcagtgtcttcagaatgaagtatctgagcagatgtcacaggcttccctggtgggcaggcttgccctggctgacctgcccttcatttcgtagaactcccctgtgggttttgatgattaacttctcctaaatgtgggctcctgctttacctgttgtaagccttttaagactaatcagtcaaagaaccacatttattgagcagctactgtgtgcccagtccttgcctgcgctctggcaaccaggtgaaactccttgcttatgtggagggagagatgggaaacagaatgagaatgtgtagcgtggtagtgaaaagaggaaggaagagaaggtggccagggctcagaagaattaatatggtaaaaatggccctcatggccaggtgtggtagctcacacctgtaatcccagcactttgggaggccgaagtgggtggatcatctgagttcaggagtttgtagaccagcctggccaacatggcaaaaccccgtctttactaaaaatacaaaaattagccggacatggtggtggatgcctgtaatctcagctacttgggaggctgaggcaggagaatcgcttgaacctgggaggcggaggttgcagtgagccgagattgcgccaccatactccagcctgggcgacagacggagactcttatcttttttttttttttaaaaaaagaaaatattcacaaactctacgtctgacaaggggttaatatccagaatatataaggaatttagacaacagaataacaacctaatttaaaaatgggcaatagacctaaacagacatttctccaaagaagacgtacaagtcgccaacaggtatgtgaaaaaattgctcaacgtcaggaatcagggaaatgcaaatcaaaaccacatcgaggatatcacctcacttcaattagaatggctactatcaaacaaaagaaaacaagctttggtgaggatgtggagaaaagggaacattcacacactactggtgggatatactatagccactatggaaaacagtatggatattcctcaaacattttaaaaataggcaggggatggtggctcaggcctgtcatcccagctctttgggaagcggaagtgggaggatcatttgagcccaagagttcaagaccagcttgggcaacatatgaagacctcttgtctattaaaaaaaaaaaaattaggccaggcactgtggcttatgcctgtattcccagcactttgggaggccgaggcaggaggatggcttgagctcagcagttcgagacaagacaagacaaaagacaagacacaggaaagacaagacaagacaaaagacaagacacaggaaagacaagacaagacacattttagcattcaaatacattttaacattccaagaaacgaagagtgggttctggagttagaccacttggctgtgaaggctggttctatcacccgtgtatcttgggctaattcatccacccctttttcttttcttttttcttttccccttccttccttccctccctccctccctttcttcttttctccttccctccctccctccctccctccccacttcttttctcttttctcttttcttttctctcttttgcaatcatggctcaccacagccttggcctcctgggctcattcgatcctcccacctcagccttctgagtagcttggactacaggtgtgcaccaccgtgcctggctaattttttatttttatgtttggtagagatgaagccttgctatgttgcccaggctggtctcaaactcctggactcaagcgatcctctaaccttggcctcctaaagtgctgggattacaggcgtgagccaccatgcctggcccggtatgttaaaatgtaaaaccaataaggaacatagtagttgcttgaaataacaggcaatcattgtggtggggaaaattagtgcccgccaattctagataggatcatgtgcttcatgttcatctctggaagtccaggggacactatagatgtcactgtaagcacttaagagcaaaggtgtaaacatctattttctcatgtgaacttccagaaagaaaggactctgaggtgacagaattgcaagccagaaacagcctccgtgcctatatttcttctggaacctaacagagcctcccacgtgcatggaactgtgctgtgggtgagaataaagctgcttgattcaggtataagaaaaaggaggagagacacagacagacacacgcacagggagagacagacatgggagaaaaaccacacgacaacagaggcagaggttggagtgaagcatctacaagccaaggaattccgaggacggctggcaatgcccaaagctaagaggaggtcctggagcagattctgccctggagccttcagagggagcatggcctgcccatgccttgattttggacttctggccttcagaactgggagagaagtttctgttgtgagcagccacgggccactcacacacgggcctcccccagacccctgcgcaagcctttactcccaggactcagctgtttcactgagttccgattttcccctgtggaacctgtgtcatgtttgaagcagaagcttgtggacaagggattcacagacacaaatttgcgattcttttggggtagcatgatgtctctccatgaagggccagctgtcttggtatggactttggctcaatctggacttactcatccttatggttcaggatgcacttggacaccaatgcagcaaggacatgctgcgattcttctgcctgctgtttttgatttgtcttttctcttctcttttctcttttttcttttcttttccttctcctcttattcttctcttctcttgtcttctctcctctcctctcctcttccctccctcccttccttccttccttccttccttccttccttcctttcttttctttcctgacagaatcttactctgtcactcaggctggagtgcagtggcgcgatctcggctcactgcaacctccgcctcctgggttcaagcgattctcctgcctcagcctcccaagtagctgggattacaggcatgcaccaccaagcccggctaatttttttatttttagtagagggtttcatcattttggccaggctggtctcgaactcctgacctcaagtgatcccccacctcggcctcccaaagtgctgggattacaggtgtgacccaccgtgcccggcctgattggtctttttgccagttttagaagcatggactctgatgctttgaatgactttgaagccatttttctcctctcttggcagccttcctggaaaatgcgtcttccggtgctgccaagtcgaaaaggggaagagaagtccaatgaaatgaggggagtgtggtcttagtgccatcgccagggtggtcattggcaagtcttggccacaggattgccttcctggctcttctgggctcaagcagggatgggaccatggagcatgggcgtgcacaggcacaggtgttgagggatgcagcatgtggattaagggaatgagtgaaatggtgggctttcttcctgtggctttcgattagcaaaggcgtctatgattggaaccctcctgcactgctgatgagaatggaaaatggcgctttctcaaaaggttcaacctacagttcccataggatccagtatttccactgctgggtataggcccaaaggaatggaaggcaaggtctggaagggcggtttgcatacccatgttcactgcagcatggtccacaatagctgaaatgtggaagcaacctaaatgtccatggatggctgattgcataagcaaaatgtggcatatccagacaatggagtatgattcaccttaaaaaggaaattctgacacatgcttccacatggatgatccttgaggacatcatgctagtcacagaagggcaaatactgtaggattccacttctatgaggggcctagagtggtcaaatccatagagacagaaagtagaagattgggtgccaggggctggggggtggggagttggggttgaacggggccagagcttcagtttgggaagatgaacaagttctgcggctggacggtggtgatggctgcacagcaccgtgaatgtgcttctgcccctgggccgcacacttacaaatggtgaacgtggtacattttatgtgatctgtgttctaccacaataaaagaagtggggagcgtgcatgtgtgtcggggagcctcaaattcctgggcccaagggatcctcccgcctcggcttcccaaagcgctgggattacaggactgagccaccgcgccgtgtactagaggccctttcaagtcaagacagccgcggctcctgcagcagctggagcccctcccactgggggcctaacatcccagcataagttcctcttctgcatacacatccggccaggctgctgcacacccaggggaaagcccctcctgcccggggcttctccagctctgttaaagaggcatgaaggcacctttgttttgttctgcacaataattcaccaaataataaatcacacacgttacccagaccaggatgtaaggagcctttcatttttttttatacacagaaattttggtctattctttaagttaggaaattcaactacagactttaaattattacgtatctgtgatctttctcattaagtttttttgttcatctttataacaggcagataaaaatgtaaaacatatttatgaactgaacacagttgaccaagccattccaagtaatataatgctttataaagaggggcttcccaatgagacagggcccccagccttgaagactgcaaaaacaagagcaaaagattccaggtcatggtaccccgtttctgaactccacagcacagcacaaaggtgacctagggactaaacaatagacatttacattaggcaactttatacagcagcagtgagggtttgcttttaatatctattggccattggtcctatcggtgtgtctacgacagagagtgagaagaagccggtgagtgcagcagcacgcagctccaatttcaacgtctcaaatttgatttctcattgaagaacacaaagaccctcaacaaatggagttgccctttttcttattatcgtttaaacaaggacatcagggaacagtttacaaatgggtgacattctcaatgtgccctttagaaaaaagggatggctttgagttatctgcagctggcattttaaagtgggattttcttttctaaccgaaattcttttgcccaagatttgactgcttctgctcaggggtgacatggcattcatgggaatagtggggatgacgcctgctcctgtttggttttgtgtggatgccggtggaggtgagacaagccttctgagggtgccagtgcacgttggtggtttccattccgatcctctgtccctcaggtcccaactgtctcccagtggctgagcccaaggcccaaacacctccctgcaaaacgtgacacctgcaagtgtggaaggcaagggtcccccatggcatcactgtgtggacctaggggcttcctcaggagggtggcaaaagtcgggcccctctttatcccctttgctcatttgggggaaactgaggcttggccaccaggtgcccacactgccaggatacgctcccctcaggacctggtgctgagccacaaatccatgacttcatggcttaagcttggccgctggacacaaagactagggtgggaagagtgctttggtggtggcacctctgatgtcacagcagacatcaaggtggtctaccgaggactcctcggcatttgccaaagcaaacagtgggagtccatccaggtgctgaggggacagggtctgaactgtggctgcgtccctgccgtcattctcccaccaccagctcctccgggcttctgacgctccctctccctccattggcttcttttgaactcttggccctgcccccgccccctcggacctgtgctcagctgaggctgctctctggactctgggcaggacccacaactccaagagtgcttcatgctcttgaaggtgggggcatggccaggatgaaggatgtggaattggagtaggaaccaaagaaagctgaaaacgaaactcccctttcactaactggaggactccttctcatcaatattttggttttttccttttagattaaaatttcccttgaaagggttttctcctctctggcaggggtctcagtgcaaatgctccaattatacctgctccagacctggagcgccccctctcggccttctccttgggaatctcagtagggccgggcagagggcaggagcgaaaggtgggggcggggtgatgagggacaaaaatgggttgaccagaaagatattcttgcagtctagttccctgaaaaaaaaaaaaaaacaactacaaccttgctacattcaataatgaaatttccaaatgaaaatgcctgataagaggaatgcaaatatcatgccagtaaatagttccttattgaaatacgcatctggccatatatacgtgtgtgtgtacagatccacacacatacacatatgtgcatgcacgcacacacatgcgcactgcggatgtgcctagtttttgcagagggcgggttgctttgtggctgcagggccgcttgcaggcggctccctcaggtggcacccttcacaggcctgcagagcactcaactttttttttttttttgcatgaagatgctgatctgattgcccctgcatgggtgcaacaaaagctccccataaacccaaaccagccccctgcccaccacacagctcaaatggcaaacacacggtaaaactgtagtttgttaaaaaagaagcatcaatagaaaaaaaggtggggaactcagctcttcgcactttctacttcttctccttcctcctttggacgaagaaccttctcctccccctttttgtcctcctcttcctccttttcctcctccctgtcctcgtcttcctcagtccggatgaggagcctgtggcaggctgcacccttgttgaatggatttgggtccttgcaaatgccctgccagaaaggtcttcagccaccttagttgttccctcgttttgcaggtgtgcaggtccccatatgtgtgtgtgcgtgcatgtgtgcgtgtgacttcgtgtgagtccgagtgtgcgtgtgcgcatgtgctgagacaagttcttgttagagggacgtctccacgctgtggagcgggctcccgggactggaggaaaacactgaagaggtagctgacttggtgacatgcgtggtcaggtagatgccgctgtctatggcgttgttgttctggttgggggacgggggcgggggggcccggaggcgctcctcgttctcgtccacgtccgtgtcgtcaatgagcgggatgttgtgggtgtagtcattgatcagaaactcgggcgtggccatgaagttgtgaatggaggtcttggattctggtttctccaggccttcatagagcgagctacggaacgctttcaccacccggatctggagtgggaggtggagggacagggcgcgaggtgggagcagggagggaggaaaggaagggaaaggaaaggaaacgtggaaggaaggtaggaaggaaggaaggagacagtcagtggccggctggtgctggtaaattccacccacgtcaatggctgggggtcatggcatgagaaatgtccacccatttgttggagggctgctacggaatgggatggctctgcctgcctttggaaagagttttcaggtgtgggccttggtctcgtcaaccgatccgcatgcaggaaaagatggcagtgtctttctctaggctgagctgggcaggtattctggaacttgagagtgctgcactaggctcttggctgtgaccccgcagttccctgtcctggggagacgagtggctttggtgacctctggggtctctgcccaatctgaattccaatttggtagaaaagaaagatgatttgaaaaggagagaatgctggtgagtgggatgtcttctcgatcttaccagaaagtccgaagtacctgctggtatgagcaagttcccagcctatgggcactgccggcctttctcgcatgggtctccctccatcccccagctcccatggctggagccgggacctgccatgtcgagggtctccctgcggctaactccactggccacttctgcatcttcgtctgatttgatccctcagggcactcaacacagaagatcatccctctttctggaagcttctcatggcttcctgacattgcccctgcctggccctcttccacctcaccagctgccctggccccatctcctccactgccctctcttctgtccctgggtgccccagagctctggcctggctctgtccctcctcctctctgtccatacctctccaccctggccacagtgctggggcccatctggctataaccagaaactgtggcccaggcctgtactcagagctccaggccagagagcccagcagtccccagctggaggtatctgagaccgaaaatggccacacttttgatttgcacccactaaagcctgtctctgctcagatgcccctgtggcctcctcacagcccccgtgtctgactgggtctggttcaatctggtgcccctgctcttctgacctcactccgcctgtcctctctcccgtctcctcctccatcttccagtcagacattccaaaacttgcgtctctgctgcctcccgggctccgctctgtgttgttccctggccatccctccccacaggagtttgcagacctcagatcagcggaacttcccgcatgaaagagctcccgctgtgccccagactcccccggcacagtggccctctgcccccagctgagcgcacggcagcccttaagccccctgaccctccggcagggcactgctccaggagcgagcccttccctcctctggcttctccaccttgcctcacgcactcaagtccttgctgcctctctttgctccctggcccctcagcctgggccccctcctgcttctagaagccaggagttgatggggaggcctctgcctggcctcgcacaggccagtgtcagcacagccgccaatggtagctggcccaccttgtactgccatccctatagggggcagcagacggagcgctgagctgccaggcagaccctggggttcatccaacacctgtccacccctgcctatgtgagcaggtggacacattaggagttctgaagcatttctggggccaaggttcgacctaggatttggttttctgggtttagacaaggtgtcagggcttgctgaggggctaaccccagctctctgctagttttggttaataaaattttactggtttaagtttcatgctgtaagggcacagttgtgtcacggcagcagagaccaggcctggaaagctaaaaatatttcctctctggctctgtcgtttagacaattaatcaccttttttcggtgactttctttcagccctccaggggctcagctaggcaaagcacagtgcttcggaatcagctgaaatgatgccaacctcatcacctctccagtgcaaaaagtgagccagggccaggtttggtggtccacggctgtaattccagcactttgggaggccgaggcgggctgatcgcttgagctcaggtgttcgagaccaacctgggcaacagagtgatactccccgttcctatttaaaataataataaaaaaaagtaagccaaaaagctccacattggaattttctagcaccccatctgaaatctggttcggattttctctgcattcgggaaagccacatctgccagacggcagatggtcagctattctcactcaggcctttatccccagactggtttctgaattaggggtaacacagaaattgagaataatttgacgtttttaatgaaaagaaacagaattcagttttcgtagccaatgcagatgttgcctcattatttaggccttttctggtacaggattgtggtgtggaagccgcctgggacatcgcctgctaaagctgttgcccatcaagtcacaaaaaggacaaagtgctgcaggccttgaccccagggctgtgtggggtgagatctcgctgagctggtggcctcattcagacctgggggcatgtgatcaggccaggcccctgctcaaacctatgcacaggtctcactgcacctggctcaactccaaagacctccataaaggacagccaggccacggagccagcccttccttccaggctgggcttctgctgctactgctcctccggtctcaccggctactccagcgtgcccctcccggatggcatctgccttgtttgtggcttaacaacagagcctggcccagagcagctgctcagcagacacttggggaatgcacaagtgactgagtgaaccgctgcaggatggaagggctgccccccaacattctgctgtttgggggtgctaagcttggctggagtcctggtgagtctgttacagctgacagtgagtcagctttctccaggctctattttccctgcatcctaatcctgggccattaaacaatgttttggtgttggtgttaaggtggggtgttttcagcccacccaacactgaaggatgcagtcgattcctgggagattggttcaatggaaagcaacaaacgtttctaagagaggcccatcccagagggctgcactcctacctgggtgctcaaggatgccctccttccaccagcctgggttcactctgtcctcatctcaggctcctgcaccgcctcctgctctgctctcagcccaggacgcgccacgccccctactgctcccaaaggaatctcatggcccccagggctgtcaatgctgtctatagaccatcaggccaccgtaaatactgcagataccagctgcaccatgtccaccttttcctggactgccagacttctgccctggctgcctcccgggtgttccccctcggatgcctaagggacctctcaaattgcaggaggcccgaggaggactcttatcagtgctccagctgaactctgcccaccagcagccttcccatcccagtgcagggctctggccaaacctcagaggcactttgaccccctgaccctatgtaccagacatccacgtgtcctgtgggccctaccctaactcaaaagcatcttccacatctgagcctctcctcacctccattgctgctgctatgtcctgcctggggccctggggtcacattgggaccccaacccccaccagcaaagccctccatccttcctgtcccttctctaggtggagtttccgagctctctctggctgccaagtcagactcttggtcccccatctggctctaaaccttccagtaggcgatggaactggcccgtgtcctgactgtgtggaaattcattgaactgtacccccaaaagcccgttttactgtgacaatttaaaaagaaaggaaatgaaagcactcttccgggagagatgcccctaggagggtcaggttgggctggaggactccccatctcatccgggtgaggcgaggtggctccccactgtgtgtccccacctccttgtgtcctcctgctgtctccctctgccacacttctccgttccccatcatggctgatggccctgagaggccacagtcctttactcctcacagtcccccagcgctgtccgacactgctccagcccctcctcctctcccatccctgacacccgagggcccctcctctgggtctaggtactctcttctggctctcggccttccattccacctgtcggctaacagcctctcggctccggctccagacttgggcatctaagctgggtctcaaacttagcaggcccaacccccccggccccagccccgtggctcccttcaaacgccatccagaacctgcacttcgcccccacccctccatgcccttagcacggcggcccgaaaaccagagcgtgtcttggtctcccccgctacaagccctccactggctgtggccctcggagccggccccagtctttctcactctgccctcttttacccctcagcctccggcacatcccacctggggacctttgctgtggctgcaccccacaccaggaaggctcccctcactcttgtcttccccagcagcatggtgcccacttctgctccttccttcaagtgccccctacatccatccacctttcactggaaggtaatccccctggggcaggggtctgtctgtctggctcgctgcacccagcaggggctcagtggacggggctgaatgtctggggcccacacggctttgcaccagcctcctgtgctggcttcggccctccccatagctctttgcccactttgcaatgcccagccggctggagctgtttctgaacaccccacgcaggggctccccggagccatgacccctgccctttctgctgcctggctggcctttctccttcctctgaacttagctcaagtacgcatccttagagaggctgtcccgggcagtttgttaccagctgcccagaggagacatgctgagtgctgtgggcttggcccgggctcccgacttgcgtggatgagcagttctgagccttacacagggcgggtgacgctgcagactgacaaggcccatccctggccacactgagccaaagcggaaggggtgcaggtgtggagtgccatgtgcgatgccactgccggccagctggagtggaggtgcccgccatgtgcatggggagacgtgcccctggttagccttcaagtgctggagtttgcagtgcagggctggggaggaggatgagggtggagaagggccgcagaagcagggagacaagcgaaggaccgagaagagtagaaaaaggaaaggaaaagagaacaatcaaagcaaagactcctgaccgcagtgacaacgaaacgacagaagctgtgcctgacaccttctcactcttccttctaattcctcaagcagaaacaagccctatcctgctgcctctgtgctgggcaccagccgacccgaggggctccatgctctctgctcagtctcagccgctaaggttcacagaactcggatgcttctggtcgatttcctccctacctatccactgctcagcaccaaccactggtccagaaccttcctttggaggcagggacctgtcagctccccaggcatctgagctttgaatttagagcagattctgaacacagcagccagggagacccatggggaacttcttgtcaagaactttagggtttccaggctcaaaacaacccctgtaggcgtgaaggtgaatcacaacttgaaagcgagacaaaggtgtcctcaagagcctgtggcaataggaaccatcagtcaactcgggcaatgagaagccaagctcagatagcctgaacactgaggagaagatggcttcggcctcacttctctatgtgggggaagagcaaggggaaggcccctttctaccccatggggatgtcacatgcttgaattaggaacaatgaaaatgcaaactccacagctggctctttccccaaggaattgaaccaaagaacggaaaagacaagacatggctgtgtgtgtgttggcaagccagaactgcttgcagctggcaagtttcatgaaaattgcctcccaccttgtgtgcacactcatgcccaggaccgtgtgagcctagacctgtgctcccaacaccagcaagctgaactgacctgggcgcggcgagtcagtgtcgggtggtcggactaaagaggacccaggaggaaggcccagctgagcccttgcctccgtactggctgaatccagctgcgggacctccaattagtcttgagaggtctctgcccaggttcccagcttgggagtccacactcggagtgcctgatggggagggccttggaccaggggtcctggggtctgccctaggctgcgttctggtgcctactttagggtttgcctggaagggcattcccctgtggtagggcccagggttccaggaaagcctagggcagggctcttgggggagggttgctactgcttccagcatggaggcagggtgcagactgtcaaagatctgagaaaaaatgccaatacaccgttcccagaaaccaggtagggaggcttggctcaaagcacatgaccttcctgagaatggagcaaactccagaaaacaagactccttccaccacggggctgggagtgtggtgagcatgtcgccctgggccctggaaaggagtgtccagggaaagcctgggactcacgtggcccggtttggcccctttggccacacggttttcatgttgccaaagccaataaaaccaagcaactgctgtgatctgtttccagcatgattaactggaactaaacggcccggagggacccccggtggccacatgggaccagactcatggcctgctgcctaacccctgctcctttgctgggccaggtcaggaggcatctcaggaacgactccaacagtaagcatctcacacaggcctggtgtggcgctgctggaaggatagactttggatgcgtggctggggtttgtctgtgtgtcccagtggaaaacagacataaaaggcctctcaagtggctttgatggggctttccaaatgatcgcgcaccctcccgtgcctcctagtggcagacgcgcagccccctgtgcctgctgcccttggtagacccgagtgactgaaccagctgtccctgaccagctctccggaatatggacacccaacagggagggtgatactgtggcctcggtgtgtgagtgtgtggttggggcatggtgtggggtagtcaccaggctgggcaggggaggggcagtggaggctgcctggagctgggggtcagaagttgtggccggcacagtctgacaatgcatgcagaggagggatatggggcctgtgttgggactcctgagtccagaagcagcaaaggtgtgggaggttagacagggtggggagggctcgagtgtgtgagcactgagccccagcgatcccaaatctctcgacccctcctagccacccccttgctacttcctgcattggccccaggggcacagggtgaggggatgtcatgctaccaaccaccggcccttctctctggaggacctgaggtccttagtaggaaaggcttgggacggaggcagctccagtgcccagaaaggccccagactcctggtgggctgaaaggcagcctggcctggagcaggcaaagaggatgggaaactgtgggcttgccttaggaaaccacgtgactcgacgcccctgcaggcctagttggggcagccctcttgtctaggggagctccgtcacagccttcagagcatctctcatccaccagaaagttccaagtagagggtgggcgctggtgctagtccccactctgccaggcctggctgcttatgggacccagtgcaggtcctggcccttggggacaacctccttcccctgatctctaggatgagagtgctgggcttggtgattgcttggggtccttgaagcgtggagtgggggttgggttctgagttctaaaccaatccgctgcactgtgatgatggcaggaggtggttctggcaggtggcttccagaagtgggcatgtccttggtgttgccaggtccccagccagcatcttcctccacggcagagtcctttctgggatgctgatgttcagctgggatgggcctcttcagagggccctgccacccaccttctgctggagcacacagtgtgcaagggacagctgccctccttctggctatccgccacttagggcccccatggaatagcttgtgaacagcaggaggggtggcgtctctcccactctacttaccccgcactgccaggctccggaggtggggaggagggggacagatggccacggaatgaaggcaggaaggaagtgctaggagccaaggaagagaggagcaagaggctgccccagggaggaagcaggaggaatccagagggagaaaagacagcaggccccacagaggctgggctggacctggagagggacaaggagctggtcctggggtgggatgaggccagagctgtggagaaggctcgaggaacgcgtggagtggggccgtggtggctgccttccccttaactcaacaaatgggcaaatggacagacagacaggaagcacagagagagatggcaaagagacatacggaggaagtcaagggggagggaggcggaggcacagccatgccccctgctgccctcagctcccaggaaggaaggtgctgggaggccacgaaccatttctggctttaactgacttggcagagcctcctgtccgcctctctgggtggagtggcggcgaggcccctttgggcccacgtctagggcactggaggcgccgactgcttttcagcccaactgccacggtgtcagccaatatttgtgacaagggtaggtggccccatgatgagtgtggagcaagctggaggtgtacgtggcctgtggtttggagaaggagtgtgtgtgtgtgtgtgtgtgtgtgtgtgtgtgtgtacgcgcgcacgtgctctgttcccaagggggacaggatgggcctcctcccttccttaaaggacagagtggcccaaaatgacagcttatgcaagaggaggggtgacccccaccagggacctctcaccagttcctaaaaaaaaaaagaaaggaaaagaaaagcaatcaagctggaagagtctgtgatggaaaaaggcgtggttaaggactcccacctgcaggggagtggcgtgttcgtgttggcagaggggagcgcttcgggggcttgctagaaggaaaggaaagaggtagcatagaaccatcctggcaaaggccctgggcccacgcgcgaaagtttactctttggtgtataaactctcttgagtttgctggaaaaagcaggctgcctggctgggcccactgggttccctgcattctctcccatcagggtagtggggtcagcggtggagtggccttccctttgtctttgtaaaaagatgtgagcaattctggaagtttctacctccttaggacagcccctgggttctctttaaactgtgaccaacatggtgggaaattttcctggcaacgtcttgaagaggcctctgagtgccagttctggggaaacctctaacacccggtggcttggggcaaggcctacagggcaggcaccacctgtgcagtagtgattggtcagcactgagcccacctggggacaggtgacagcggcatccttaggaaaccacttcaaggaggatgctggaagcgccgctccagttcctgggtacgtgggctagattcttctgtggcaaacagtgtgggaaaggcacccgccacccctccagccccgggaaggcggccctgagcccgcgtgctgccctgatgctgcaccactgaacactgagcaaggccctagcctgacaccagacacccccagaagcggcccaagttcatgaagaaccatcggcaaaggcagacaagttcaagaaaagagaaccaatggcacaaggagcactaaacacaaaccgaaaaaccaaacaaagcaaagaacgggaggtccggaagtgccatgggttgaatacgtttcataaaagaatatggctttcgagagacaccgtctgggcgggaaggactggacagggcggtaaagaaagaacagaaaagccacggtgagcggaatgcaagactgcaaaagagagaaggccgagctggggaggcttattcttccccagagatgccatttatgagagaaaagggaagtcaagactcactcccagcagcactggtaggattggcagcagagagaattgcgtgagtaggggtagaaagattggttacgtcatgaagctggctgaggaccgaagaccgccggcgcacagcaccctgaactgaaccgcttctcttgaaggtactcactacctccatctgtgggagagaaaatgagataaagtttggcttgcactgttgtccaggctatcacggaggggagggctgggcgaggataggggccaccactgggcacatagggtgacagcaaagcctcatcgggtcaccccgctcactgggagctggcgatgtttggacagggccctgactgaggccagcctctgtgccacccaccgagagagggtttgctgagcagatggttagtggtcatgagattgggaagggaagggggtcacaagtcagggcacactgcaaacatgtcagaaatgccccttgcaagccacttatcaggaagtacttcatagttctcaaccttgtttttcctctccaacacacctgagggacatgacacgctcctattagaacccgccctgcttcctctaaacccggaggacttatgccccatgctccatccgcctgcccgtctccgccagcttctgtggctcatctgagtgactgggcagggggcgccccctcgaaacttcagcagaagaatggacctagcggaggagggggttttcccaccgactggcagccgtggcttcgctttgtccccactcttacagcttcctgcaaattgaaggggaagcaaggctggggaaactgaggcctgcaggagggccttgacccagtgtctttggatttcctgacctgcccttggctgggatggggactcatgtccgtctcactggagatgatgtgaacagcaaagccagtgtgcgcatctggagcccaaagctacctgctccagcccgagccctgcagtgctatgtggtggccaccaggttcacctgggtgtcttgaaacgggccagggcttcgtggaagaaggcagcttgagtgttcagactccccctgcaccggccaaaatgaggatgtacgccacttcagcctttgacgcgctgtggaaaggactcctccttcttctcagcctgcccagtccccttccgcccagcacatcccactcgcttgcttgtcacaaggggaacctcatggcacttgctgcgaccgtgaggaatgcatactgagtgtgtcagcgcacggaaggaggatggttgatgtgatggcgtcgcggtggcttgcggggtggggggtctcctgtctagattcaggagaggactctcgctgcggcaaaagtgatgagggataggaaagatgcctttcctgcctcagatttgcattggtctggcctggctacagatggtgtcccagtgggagagccacatcagtgacaataccacagtcgccaccaccccacacctggaagcccaagagctgagccgggagcaaggcccagttgctgacgaagcttctctttgcattataatgggatgcaaaaaagacagaccgagtcatgagcgcttcagaaagctacatgttctgggtttgaaggactcttttattctggaatgacaccctgtccatctggtgcgttgatatgttagtatggaaccatggtgcgagcaggttacaaaatgccttcacttagcaacagaaaagcttgtgccggcctccaaaatctggggagcgattttgtggttcccaaaaagcagaaacctggggccagctgcctaggaaatgtttttcttggcttggggcatacgtacaacctgacgggcttctcccaagctttagctccatttttcaagcaggtgtttcgaatcaaagagagcagatgctcttacatagctggctaaaagaaccgactggttcagcattcctgagaaacatggtgagttggatgtgacaaagtcaaagcgaaaagccatgggggtcaggagcccgtggaagagtcggatcggctggtgccaaggggaaagagtgcaccctgtttcctcatacgcaaaacaggggactcagctgcccgtgtctctgtgagcaccgacaattggaacagcctggaactctaagactctgaccgatgggactcgcttctactagccaggctgcagcggcccccacatacagaggacacgagacacacaggtggccggggtaccactgacaccactgatgcttcaggtcagggcagggctgttgtctcagctgctggaaaacctaacgtcgccttcggctgcggcggcaggagtgaagtgggccgccgaggggcaaggtcctgctgtcctcaccccccaccccaggcttgggcagctctgggctctgtagcacaacaggggtacgatagataagagcccatctgggggcagctggggggcccataggcatggtctcgtagaaggcacagttgggccgctaggagggcactgggggagatgtgaatgctgcttctaacattcgatgtgtttaagatttagcgcagaaatatttattgcagggaacgagaacagactatctgtgctgcacccctggcctgtccgagcattgtgcttgaggcagtagcccctgcacgtgggaggggagacgcaggccatctggcgacaaagcctgctccccttcctcaccggggctctctgtgttctggccaggccagggcataggtgacagtgttcagagtccagacctaacacatccttcccaggctacgctgtgttcggtgcctaggatgccagcctcgcctcccggttctcagctggagaggccccttggacccctggggggctcttgaaatgtggagttctttgttgccccttgacctagccctgcgtgatcgtggtctctgggggactctgtagctctggaaagttttgcaaggagcccgtggtgagagtgagaggagtcaaagagggctttgtaagcatgagggcccaggggacgcagcgggagttggggaggtgcagtggcacaggcgggcagagggcatgattggaaaggcagccgggggtgcaggggtgcaggtgtgcaggaaggttggggtgacaccaagaggcaggggcttgaaggccatggtcaggagcgtagacttcatccttaggacaatggagagaggctccaccagtcccactgcagagggtggtgttggaggggctgagctgagccaaggcaagcaaaggaggctgaggcccagggagtggggttgccctgaggctgggtcccttgagactcggcccttgagaccactgggagggaacacaggacccagggcaccaagaacagctttgtgcaagttgcatggatgattctttgggacaggcccttggtgatgtgtgactgaccctgggaaggggtgtggcctcaggccccgcctattcccgcttgagctggggctggtggctcaggcgggccctggctccgcagccaagtgtgcagtggtgtccttactctggcaggacctcagggaggagggtcagtcgctccatgtcaggggcattgcaactggggatcctggacagggcctggaggggcagggagtgatggctgtgacctgagagatggtggcccaggccttgcagaaggaggtggagtgtgaagcatgctgggtggccctctggaggctgctgggggaggggcaggccatgaaggagaggctgcaggggctgcggtgggagaggggccaggccgcaggtggggtccccatgggccctttcttcctccccggccaggattttcagcactcaagggccacagcagggtggggcgagggctgagcaggaggtgggggtgccaggcgggtgaggacagcaagtctccaggcagtgcccacagcaggcaggaacgatgcagggacagcccgaccccacgagccggaagggagcctcgcaggcctaggcgagcgccgtttctggggagtggtgggcagaggccaggctgtagtgggatcacaagagagttccagggaggggtgtggagacacagcgagtctggagcattctggcaaaactgttggccgggaggagatgggaacaagggagcatggtagctctggcaagcgcctgatactggtggcagtggtggccatctgacttcagagaggaacacagctgacgcccttggtcttggccggccctaacccttggtgatttggatgaccagaaaggaccaactcggtggccagagtccacttcccaaatgaagtctccccatcgcatttacagtgtcaaccagtgaaccttgagctcgctggtggctgtttgaaatgggcctctcttcccgatactgtcacttgcctatgacctggggccgttcccaccaagtgaagggagccccagcagtgatgaggacggtgctggcctgtgcctctgagagagccattagtcacccacacacacctttagctacaggggatgcctgggctctgaaggagctgtcagggagaggcgatctcagtgccacagccatcagcgggcacagcccggaatggcaaaggggacactggcagctgcttttgtgaccttggcagcaagaccaaagggtttccctgtgggtgtcgggtgcagacggccggctctcggctgctgctggccagcttgcctctaccctcttggggtggaagtgccagggcgagagcgagtcggggcttacctgcgtctgaatccggttcaggccccggaaccagaggatctggcccctgcggagctcccgctcggcatggtcgatctcttcctcgccttcggccagctcctcgtcggtcatctcgtccttcccgggcccgtgcccggcttccttcaggcacttgagctggctggtggggatggtggcaatgacctgggggagccacacggaagtggccgtgagagccaggctgagcagcatctgcctggtgtaaggtccctctccagagggagacgccggcctccttcttccaaaggatgtcatttgtttttgtgactaagcaaagggagtaaagctagagcagtccccccgggaactggcagcccttggagaactggcgtagtgttcccccggggggctgagatgcattttcaggagtacgtggagctctgggccagcctccgggacttcgagaaagtaagtgtctgttgtctaagcctcccagtctatggtattttgctatggcagtcagagctgatgaagacagagataagcggatcctccatggagctccattcagccaaagggcccagggagtggcccgagtggaacgcggtgcagcaagggctcctgggagggatcgctaagcccctggaacatcctgcttgagagcagcatggctcagtggggcagggggctggggaccgtgccccgtaggctacactaacagctggacctccagagggctggagatggaggccagccacgtgaccacagcatggctctgtgaaccaccgcaagaaaagccctggacaccggggcctgggtgagctgccctggttgacaatactccctgcatgtcgctccacaccgttgctgggagacacaggcgctgtttgcgcaactcccctgggagaggacagctggagctctggcctagtctctcctggagagggcatctcctggaggaacaccagcctagagaagacctgtgcattgggggctagagagggtgggaggtgacaaggagggtgacagctggaaagggtgactggataaggagcctggcaggagtaaagagagggcatggcttcgcatattgtaggccactgggaagtggggggaacagtctagaaggacgcaggggaagccacagaaagggatgatgggcatctggagttctagagcaagacgtctcgtctgtcttgtgtgtctatgccagtgtatttgtcgaacatggccaggaggggacttgaggactggttcacagagattcccttcttttcgtttttctcttgaacatgttttatctttgtaactgaacaaggttaaaaatgaaaaggacaacccagtagccctgagaggccgagctacaggctggtgccacattcctggggggaccagaaggccagtggcctgggagcttgaagagcaagaagagggcctggcacccctctgggctgtggttagagtccaggtttcgggaagtgaagggactccatggagcaaccaggttcaagtgtgattcggaggtgaggtgcagtagcagagggaaaggagaattctgaaaatgaaacaggaactgggtgggctgtccccgaggacactaatgctggggccagcaagaaggctggcatctgcagcagctgcagcagcccctgtggccggcacagagatcaagaaacaaaagccaggccgagcatggtggctcccgcctgtaatcccagcactttgggaggctgaggcaggcagatcacttgagttcaggagttcaagaccagcctgggcaacatggcacaacacatctctacaaaaaatacaaaacttagcctggtgtggtggcatgtgcctgtggtcccagctgcttgggaggctgagataggaggatcacttgagcctgggagttcgaggctacagtgagctgtgattgtaccactgcactccacattgggcaacagaacaagaccctgtctcaaaaaaaaaaaaaaaaaaaaaaaggaaaagccagaatgctatggactgaactgtgctctccagttcatgtgttgaagtcctagtgcccagtgtggctggatttggagtaaggaagtgatcaaggttaaatgaggtcaccaaggtggggccctgatcctactggattaatgctcctaggagaggaaacaccagagaccttgctccctctgtccaccatgtgagcacagagtgaggaggcggctgtctgcaagccaggaaggagccctcaccaggaactggccccgctggctccctggccttggatatccagcctccgggacttcgagaaagtaagtgtctgttgtctaagcctcccagtctatggtattttgctatggcagtcggagctgatgaagacagagataagcggatcctaaatacccaggctgtttcttcctgatctaattgtggggtcctagaaacctgccagtgtgcggcttcagctgcagcccacagagctcgatgtgggactctctgtcctttccatcaggtcaaaatatttcctaatttctctggagactttcttttcgccccatggattattgatcagggtgctgtttgattgatttaaaatatgtggggatttcccaagctacccacccaattggaaggggcaatttttggctcttatcatagaaaggggagctgcgggcagttttcctgggccctgtcacatcccagccatgttcctttgcattcttttgctgacaccttcccttgcgtcctgtccctgggtcctggtgtgtcacaggcctgagccctcagtgtgcttcctagggtgaggaccccaaggctctgaagcagggttagggcaagtgggcccatcacagaagctgtctgcagggcagtctgaaatgaggggcagggctgtcactcacctgtccccagaccagctccccaacaccaacaaacaggcaccagagccactgttctgtggatagtggggagcagctgaagggcttcccgccaaactggacgatgacaatctgcgaagggcaagtgggagagaggcaggtccagccgcggctcctgagccacccttgtcctccaaccccttgaagacccagccaccctggttggttcccccagttgcacgggctgctccttgcgagaggaccacaaggccgggggcgtgatgacagagcagtgcatggcccccagcgcccctgggtgccaggcacctactgactccagcctcggagtggggcccagctccactgaccatgctcctattttcagcaagacggaggctgtgacacccaccctgcgggcacgctggacatgcctcattctggaggaccctagaacctgccgaggtcaccttgtcttggcctcctgcctcctcgggaggcatccaatttgcaggggcaagctgtccaaatgcaaactgaccccgtcctctgttggactgtcacattccgggccactatccccttgcactcattacccaggaccaggtaccagacagccagggagcacccgtatgccctggaaccgctgcaatgacgcaacctagccagtcctgagcctaccagccctgcctcacctgctcctccccgagggaaccacagcaaaggctcttgtccacagctctcacaccccacctcctgcctggcgctctcccatgtgggcccctatggtgtggcatgtgtcctcctcttggggtctctgagtcataaactgtctttcagtggcaactgtctcttgaccttttggccttactatacctcaatttttctacaaatacactatattttagaacacttagcccctcctagacagtggggctgaccagcctgtccacagcactgtgggaagcagaggttagtgtgtcagcactgggcacagaggtcatctccaaaagaaacttctggagttatggcagcctcatgccaaggaattaagtgctagaaatgggaatggcagacctagagggagccagggaggactccttccagcatctgtgagaaaacttcgttccgatgagggctcacgaaacccttctggaagccagcgcgctcacccagggcaaggccggcaatgtttggaagatgaagaaggccctctccgacatgcagagaggacgggggctacaggaaagccaggtggggtggggctccttctgggagtggaggtggggaggccagtactaggggtggacgaggggtcttgaagcccaccacctccactttttgcaagtggcagaggccaagagtggagccgcccctcctacctgaatcccgaaagtgcccaaaacgatggtgcagaagatggggttgctgaagatgccgtcgaacacgttcctctcgccgtggatcttgcgggcgttgatctcgttaaagagctgcatcatgacgaacgtgttgaagatgatggtgtagtgctctgagggtggcgagtgcaggggcgcattcctcccgctgtcgatgtcgaagaagagctcccctggaaagcaacattccccactcaggcacagtcatctcagcgcatgacgcattactcaggagcgagacttcggtgtgtagctcccgagatgggtcccttgtcccaggggatggccacttccagctcacggccaaggcccaaggcagccacacccaccccaggctcaaccaaccagagtcctgagacccctctgggccaggggccagaccctgagcctgagggcaggaaggaagagattaagaagggaagttcttaaggctggctttcctcggacgccctcctcctcttcctctctcttgcggtcaccccccacccacctcacagcttccagcacggcaccccagtcactccacaggagcaatcttcacagggtaaatgtgggctgttctgttcctagggttaccgtggccactctggggctgggtagaagctgcctactctacacagctacacagccgtgggcaggatgtcaagacatgaactgtttctcagctgctcagcggcctgggaggagaggcttgcgaaagagctgtaggccaccagcaggcctggctgcagggttgctagcctggcccatctgctccttcccctgtgtgctgtccagtcaggaagtgcagcgtcccaccccgtactgggtgcggagacacaggtggagacacaccagacagaatctgagcccgaggtggtggcaacagtgtcctgaagtcctcccgggtgcccctggccagcctaccgacaaacagcagggtgaagatgatggcgagctggtacacggcgtggcccagaatgttcttcatcatggtgcgggagatgaggggcttgtcgcggccgtacggcttccgcagcagcagcgactctgtgggtggctccgtcgccagggccagagaggcaaatgtgtccatgatcaagttcacccacaacatctgcacggctttgagaggagagtcctatggagaggaggcagtcacctttccatgggccgcctgcccgggaaggttgggggtggaaacccagtagctcctgggggctcctcatggggtccacatcaccaggatttcatgcccatgaaaacagacatctccatccctacatcgcctttacgctagtggggcgttttctttgggctgtcacgtgcccgcctcccttctctcacctggcagcaggtgtgctccaaatccctcgcaggaggtgaaaaaccccagaccacaaaacagcccgacgatggggtctgccatttggggcaacagagtgagggctgctctccttgtctcctgcacctcaggggcaggaggaggcagaaactctgaactggaccttccttctcagctcctctgagttgttcgttaaaaatcagcctcacagaagccagacacacaaggccacgtactgtctgattccattcataggaaacttccagaactgacaaatccatagagagagaaagcagatgagtgggtgccaggggctggggtttggggagtagagagtgactgctcacggggtctgggtgtccttttggggtgatgagaatgttctgggaatagacagtggagggatataaacctcggagttatgtactttcaaaaggttaaaatggttctgttgaagtttgttatgtgattttttatctcaatttaaaaaattgttttgaaaagaccaagttgatcagcaggcaatttaaacaccccctttctaaggcggggtgaagaaaatctggacactcaccaatggggaaaatgggactgttgagaaagggttcccatgggacgcatagcccacgcagaaactcatacacagatgctcctggcagcaccattcacaagagccaaaaagtgggaacgagccatgtgtccatcagggcagacatacataatgtggcagtctgtgccgtggagtgttatgaggccatgaaaaggcagaaagtcctgccctatgctacggtgtgtgtgagcctgaaaacacggtgctaagcgagatgccagacacaagaggccacatattatttgatcccataggaatgaaatgtccggaacaggcaaatccatagacccaggaagcctgtgagtggttgccgggggctgggatgtttgggggagaaatggggaaatgactgctcaagagcacagggtttctttttaagatgatgacaatcttctggaactagatagagccaatggttgcacaacgtggtgaatgtcctacaaattcgagtgctgaattatgtacttgaaaatggtgaatttttggcatatgaatttgatctcaattaaaataatctgcagcaaagaaaacaaaaccctcactctcacaatctggccctcaggcctgagcccaggtgtcctagctggggcatggcagcccccagtacccacctgagtaatgcaggcacctgtgaaggccacgatcacagccaccacattgaccgtcagttgaaactgcaggaacttggagatgctgtcatagacgttacggccccacatgactgccttgacgatgctggtgaagttgtcatcggtcaggatgatgtcggaggcctccttggccacgtcggtccctgcgatgccctgggggggtgacacacacactcacacagagtgtttgtgggggccccttccccagccccccttgatcacctggcccgcctgggctggctccctgctctccccttctgaataacatcccaccccgccccccaaagccaagaacagcactgttttttgttgcttttttttaatgcaacacattcttgtactacaaacagtaagttgtcacatgtcacggtgggggggggggctttgctcataaacacagagggtgctgatgacatggcatcaacacagctttacacataaagcccagctgccaccacgtggccaccaagcagcgtggtctgttcttagcactccagagaggcttgctggctaaggagccctgggaagtcctgcatggggacaccctgggcggggcggctccttgcagaggagtccctgtcccatggaggcgcagctgcagctgtgccaagctgcgcagtcctctcctctgccccaagcctggccccgtgagagctgccacctctcgaagcttgggctggagctcccttctgggctacgggtgctgggaaggactgggctgggttccctgggtgacactccttttcggtagggcagggagaggggctcaccaggttgctgcgttcagtggctgtggggccactgaggggccgcaaccagccatgtgggtggcgtctgcagggctaccctgctcagtgggtgagcaacaggaaggaagtgcagaggaagagcacatctggggactctgctcacctcatctggggctgagagtccatttagagaggacgggggtgggcaatgccatcagtgatgagcccccaccccccattccccttcctctccacagtatgtctggggcccactgtcaccttgggcatcacagcagatgcctttaaccacatgtcccccgactggcagagcccacgcaggcccaagtggccaggatgtgaaagaaagaaccttcaggcactctgtaacctgccccgacactggctcccacttcctggtacaaagctaatgtccatgggacagatgcaggccccatctgccgtggtgagctgggcgggcaccaggtggcttaccatggcgaagcccacgtccgccttcttgagggccggcccatcgttggtgccatcccctgtcacagccaccacctgccgctgctcaccagtggtgctgtcgataatccctggaagacagatcagggcagggcagggctggggccatctgtcaccacaaccctgtgtagccctgcccagggagctatgggggtaggttggctgtgaaaaccctttgggattaccccgtcctgactgtcccaattatctgtgctccccgtcacctggatcatctcctatccccaaataagtaagcaaatctcactgagtgacagggccagggtgggaggatagggatctggttagggcctggggacacaatcctgggtccctggctctagacccactgcttctagagactcactgtgtgacttggagtgagtcactagccctccccgaaccctggttccctcatgggcccctgccctgctgctctgggctaatgggacaaatggacccagcttcctaggcaggccctggggacctgtttgggaacctggcttttggtgtcaggaagcagacaacctcgggctggccaccccaggaaaggggtgtgggggctcggctacctttgaccagtgtgtgcttgtcggtgggagacgaccgggccagcaccctcagcttgggccacaccttgtccagccgctcctgttctatctggggaggggaagcacaaggacgctgcagagctaaggcgggcacgcagggggctggggtgaggagaaggggggtctggggtggcagacagccgggtgctacctcgcctttctcattgcggatccgccggttgaactccttcccttctaggcacaggaagtcctccccgggctggatgatgccgcatttggctgcgatggcccgggccgtgttgatgttgtccccagtcaccatgcggactgtgatgccagcacgctggcattttcggatagcttcagggacctagaagagacaagagaggtgggcggggccatcgaggcaagacgtattttgggttgaggcagtaccccttcctccatcagatctgcaggtggcccaaggtccagcagaggtgagagtaaagccatccgattcacgtgctcagaacacttgtgttagcctacagttgggcaaaagcattgaacacaaagcctattgtggaatacagtgctgattatctcatgtaactcattgaatcctgcactgaaagggaaaagcatgggactcgaagtaaagtttctgctgaatgtgcatcacctttgcaccaagttacaaaattgttaaaagttggggaccacctgcatcacattagattctggagaaagagaaagaggttccccagtgctgagtggaaagcgaacagcctgcaaggggttgagagcgggaagccaggagactggccgggaggtggtggcattgtcccagtggtggggggacagggaagacagttcccaaatgaagaggtatgtggctcttcaggctcggggacagagagacagggtcaggcagctgatgccactgaggtagacgggcagggggagaggagaagaggagccaggttcagagtttgggaacctgaatgaggaggtcaagcctaggcagtggggcttgtgagcaccgtcgggtaagtgtagaagcctaggtgtggccgagccgccaggcctggggagcctgcggcggtggggagtagacacgcaggagtgggagccaggggtagggcagccgggagacaccaggggaggacattgacctgggagtccctgaatcctggcgccccctgaggccatgggcaggggggctgtgatctttgccagggagacagctgggggccccactctaagctgtgacagggtgatccaatggttcctgcagcatataccactaagtggcctcactgccagcctcggggacacttcgtactctctgaggatcttggggtgctggataacaagatcacgagccacaagaagacaattctcctttgagccagcgaatgcctgtccctgaaaagtctggaagccacccctctgctgccaccaagtggccgtgacgagcctgaaaaccagcagctgcgaacccaggcctcctccctcctcaggcccagtgtgtgtagcccagttccttccccatggccccaaagggccaggccaggctgtccttcctcgcctgctcagccctgctccctgccttctccccaaggccccacagcacagcagccagccaggtgtctggagaagttgccagtgcccccggccggcccagctccagcatcaataccaccccagccacaggcttcctatggctccccagggcccagcctcacgggccctcctctggctgcagccgtgccgcatctccaagcaccctggcggtttcagtgaggcccttgtgtcctactgcctgttgccggcacccaggacttcgctgggccttctgtgcgtcctcctcagccaccaccaggctggccagtctttgtgggggtctgcccagcctccgcagcctggccctgtcactgtggtctaccccttggactctctctcagccactcttaagctggaaaggagctgtccctattccccaggcccctctggcaagattccttcctctgctctgtgcttcagttgctccctggtccaacagagggactcgatggctcctgtccccaagtgtggccttgcttcgcctcaccagcaccctctccttctgctctcccaggctcagtggggcccgggactcatgccgctgcccgcctttgcggggcccatttccctcgctggacttctgtcccctgtcctccgctaccacccattttctcccagggcaagctcgaggtgctccctctctgggcgcagtgaccatgttctcctcggggcacggggctgctctgttgacatgagccatggctggcgtttagacgcactgtctttgaattgagtgtttttgctacatgatccaatacatgaatgcctgtctcccgaaggagagcccagaagcttctcctcccaggttgcacctgcacccccagggtggctcctacaaagacaagttgtcagggtcacagtggccctgcttgtgacacaggtgggtgccatgcagaggccctggggagacagaggggcaccccatgccttgcattctccctccggggccggccatcctccacactctccagggtctgggatctttcaacaacaaagtgacttcccagtgtcaaggccatggcatctgccacgcggccctcgaggtcccctcatctggactcccctggtggcatcgtccatatggggatatgcttctgggctccctttcccgccaggacctttgctgtgagctcgccacaggacgtcctgaccgtagagtagccccagccaaaccctcaaccaataaacgcccaccctgtgccccaaacctgtgtcccctcaggcttcagcaccacctccagtccatcggtcctgggtggatcagatcccaaatgtcgacggtctctccgccactgccaccttctcacctggtagaaggtggagcctgagctgggcccataggtcaagcgggaagggctttccagcaggcaggacagagcctttgtgcgggtgtcagggtgagagcacccaggacggggctcaagtgtactacggagggaccgcagcagctgtgtgtgaaggaaggccgcccctaccagtccggacaagctcgggcagagggcacagttaccagggcagctcacagagaaggtggtggctacctcgggccgcacagggtcctcaatgcccacgacagctatgcaggtgaggtcacccacgacctcattctcgttgtcccagtcgggctcctggcctgcagagaagtcccggtaggcgatgcagatggtgcggaggccatcgcaagccatcggctcgatgatcttcctcaccatgtcgtcccggtcccgaggccgaaagccccggagttcgccattgctgttcaagatgttggtgcacctaggcagggggtgggcagagatgaggtggaggtggggagagaacaacaaggaacagcgctggtcacactggattgggggcttagtcaaggactggggtccttatcagagaggagtgccccgtgtgagaacacagacacacagggagaagggcgtgtgacaacaggcagagattagagagggtcagctgcaagctgaggaacgcgaggactggcagccaccaccagaagctggaggatgcaggatgcatcctctctgagatgctttggaggcgcttcggccctgcccacgccctgcttttggacttccggcctccagaactgggggagaatccatttctgttgcttgagggcaccaggacgctcatgcactgctgcaggctgagagaccgggagggaggcaggagcatgtggctcatggcagctccaccacagacttcatagggcaagcgggtggaacctgggcaaaaactgaagtctgtggacaatcgctataaccacgtccaggcagccacagcctcagtagagcgctcatgactccaggagcttctcaaaagggacaggacttgggaggattcaggtggggagaggagggagcaaaggagccgagggtcacagaggcgggcatggtggaagaagccagtggggctgtgagtgccaggtgctgccactgcatgggaggctggtgacgaaggaaatgatcataacagaagctgtgtggacggagagcctcctatggatgtggattcacccacggaaccctcacacccctccccagagataagtattctgtgatctccatgccaccagggaaactgaggcatgggagtaagggggagtgaagctgggctgggccttttgtccgcagtgcctcagtgtccctcagtgcccaccaaaaaagaagcacagaaagagggctgaggcccccacaccagcagggatggctccagggaggaggtggtcctggccctggcagtgagcgctgcacctggcagagttctgggagagcgctgtgggtggggcggccaggcagggtgcacttggtggtccagtccgcagaacacaggaaggagcgtgggcctgggcctttggggagccctgggcgtcctgcagaggaccttgccctgagggccctgggacggcagtcatgaggagcgaggtgacttgtggacagagacgccaaggccaagggtgtggagtccgggaaggctgagtgggagtggggaagccagggcatttggaggtgacgctgtgcactctcccttactttgttctaatagctttattgggatataattcacgcaccacacagtccacccatttaaagtagataattcgatggtttttagtatagtcacagagctgcacgaccatcaccagtctccaattccagaaaattttcatcatctctaagaaaattttcatcatctctaagcaacaacaagaaaatagatcaactggacgtcatcacgatttaaaacatttgtgcacctaaggacactatcaagagagtgaagacaggccacagaatgggacagaatgtgtagaaatcgcatagctgataaggatctaggatccagaatacagaaaaaatgttacagcccaacaataaaaagacaaacaacccaactcagcaatgagcaaagggctaggacagacatttccccaaggaagacaggcaaatggccagtcagcacagcaaaagaggctcagcgttgttagtcatcaaggaaacacagatcaaaaccaccaggagatattgcctcacacccacaaggatggcccccatcagcattgtcacaccagaaaataagtgctgttgaagatggggagaaggtggaaccctcctatgtcgctggtgggaatgtgaaacggtgctgcccctgtggaaaacagtttcgtggacaccacgacccagccattcctctcctagatgtccacgcaaaagaattgaaaacatgggttcaaacaaaaacttgtacgtgaatattcacagcagcgtgactcgtgacagccaaaaggtggaaacgactcacgtgctggtagacgtgctggtagacagatgaagggatggatggaccaacacaatgctctttagcatacaatggatattactcagccttagaaagaatggaagttcgggctggtggcagtggctcattcctgtaatcctagcacttagggaggccgggtgggtggatcgcttgagcccaagacttcaagaccaccctgggcaacatgaggagaccccagctctacaaaaaatttgaaaattcgctgggcgtggtggcatgcacatgtaatcccagctacgggggacactgacgtaggaggatggcttgagggaaaaaacaaaacaaaacaaaaaaagaaaggaaggtctaatatctgagggaaacggaaaaactttacactaaggaaagaagccagacacaaaaggccacacagtgtatgagtcccttgataggaaatgtccagacaggcaaatccatacagacaggaagcacatgaggctggggaggggcgtggggagggctgctcatgggcctggggtttctttccgggttgatggaggtgttttggaactgggtagtggtgacggttgcatgatattgtgaacgtgcttaatgccattcaactgtacactgtaaagtggttgaaatggtgaattttacgttcggcctcttttaccacgacaatagaatcagaaactccgtgcgtaccccggcacctccctgctgctcactcactttttcaagaggatctctgaggcccccttgctgaagaggcggaagccaccgtcgggcatgcggatgactgtgctcatggacttgcggaccgagttgaaggtgtacactttgtaaagcttgtcttccgggatctgctcgcgcacgggctggaagtcccgcttcaggtccaagacgaagcccagcagggcgcactccgtcttattgcccacctggcgtgggagggcgccttccttctcaggaggctgcaagatgacgagggctagcaggcactgggggcctgagaccaccctccatgctgcccctggagccccagctctgccccctcgtggtcaccacattgttagggtgtgggcggcagggagcagaggaaggtcggccttagctacaggcagtttcccagccagagccacctgtgaggccagggatgggcaaaagttctcaagggggggcctaatgagcaccttgcaacagctcacctggcaccctggccaggaccctcccctgctcctgcccccggccctgcccgcccgctcctgccccagctcactagtattttggtggtataggcactgttgatggagatggcatggaccaggaggtcgaggatcttaggggtcagggcgctgggggccggaatctctttgtagtgggtgtctcctaggtaggactggaccacggtcatacggttggtggtgagcgtgcccgtcttgtcggagcagatggctgtggcgttgcccatggtctcgcaggcatccaggtggcgcaccaggttgttgtctttcatcattttctgcaaagggcgagggtgtgggcatttggcccaggtgcttgttggggtggaggagtgagagatgtcaacacaaacatcgcgtgactctgttctgctcagctagctccacgtgtggcactaagcccactgggcacctggtcagccctgagccaatagcgaggctgtaaggcatcagcaacctcatccaatggtgggggcgggatgcgcacccgggacctcccctgcccgagccccctctcagttacccaccagccctgcagctctcccaccccaccaccccaccaccccaccaccccacacctggctccccccacctcctcccactgcctcccagtgtcccgggccctctgctgattctccgcttccccgctgcctcccagcccctccgtcctactgcccacattgtgcagatgctgaacccctgggtatctcaccgcctgcctgctttctggcccatctcatgccgagggacctgagctgacagatcagcaaagctgccccctgggtccctgctcggcacctcctctcctcccttgagctatcccaaacgtccccagtttatactgccaccaaggcgcccaatgacttcttaccccagtttccgagtctgtaaacagtatcaactgtaagttttatgattaccttgacagagtaagctaaggagatggtgacagcaagaggcaggccctctgggacagccacgaccagcacagtgacaccaatgatgaagaacttcacgaagtattgtacatagaccggcgtgcactctgccagccatgtccggccttccacgacaaacgtctcaatcacaaagtagaggaccaggatgatgacggtgatggcagacatcaccagccctgccacagagcggggaggagacgaaaggggttgccacgggtgagggaaggagggggacaggaagagggaagaagaggtatggacacggtctcggaggcatttgtgaaggccttgtagatttgccttgcgtttcaggataaacagcccaggtttggctcagcaggtgagctggggcctgtttgcaagggggctctgtgtggcctcttctggagtgctgctggggttggggagtggactttgtggtctgatggcaggagaagcaccgctggggaggactagcaagagtcaatcccccactgcaccccagaagttggggtaccagccctgcatgcccccagctgccttttgagggtgccaggggcagagcctggagccttgggtaggggcacctcatgggcagtggctcagtgtgtgacccgggctttcgtcgagggtttgggacttctgctcactagggaagggctgcgccaggccctgatggccactgccggcctggcctgtgcccttgcctgcctggcccacacatcacctgccacatcccttcccacctgctctacacagcctgggctcatctccaggagcccagcatcctccacgcccagtcaatggcctgggcccaccacctcctgctgtccctacctgctttcccgatctgcacggctagctttgtgagcttcccctgaaggacagacttctcctttttgggtgcgttggctttcttcttctcccgctcctccatctccccaccctccgcgctcttcaggggctgcatctccatggccactgcaccatcctgcttcttagctgcacacagaggaaccccatggccaaggtcagtgcctggctggggagaaggcgttataaggggcttttgtgggggaaagacatgccacaccatagagaggagacgggattcagtggagctctcctatttccaagtctatcagcttcccttctctcgcctcctaagcccaggccctcttggggtgggtggggtggctccagcactgttctaggtgggacagagatggttctctcgggagaagggaggacagacacagcacaaggcttttgggcacacagacagggtgactggtcctggaatgccccaaataatacctgagagcagaggcctgtggcccgaggaatcttccagaaccctgagctgactcatctgcttactggtgtccgagccacctcctacctcccttagggaggcccagaagccccatgcactctcctcccaccagccagccctgcgcctgttcgggctccatctgtccctccagcaccctccctgcctctcccctggagcagacggctcctctcccttcttccctggtgggtcctgtgctcctcatccttgctgccctcgacatggtggtggtgtgtcccccactccggctccctcctctccccactcctctgcttctgtcacttcctcatctccctccctgccaagctctggccgcacccactccacggcccagagtaatcctggccaccccacctccctcttctgccccgggaccgacgcagcgacctggggagagcagactcgtctttctccctcactactctggtccccgatccactggggctcttggcactaccgccatcacctctgcctcctcctgctcctcctcacttgccagcccaaggccattcgccacggctcctcttcccagtggcgtcaggacacaattgccccacccagctgggcccctccagctttgtgccccacctgctgccacctcctcaacccagggctgcagccatcgggctgtccccccactgccctcccaaacccagctccgcacagggcgttgcctgggtcatctctgcctgtgaccttcctgagggtcaggacctgccttgttccccatggactccagcacctagagctggctgctgcattggccgacatctcctgtcctccgtgggccacggctggcctcctccccgctcctcccaccccttctcctgcttcctgcgtctcacagccaggctcatgctggccccagggtgtcggcacctgccagctgtccggggctgagaggagagccgggcctctggccctcagccgaccactctgtctcccaggtcctcaggcttggctgaaaggaagctggcctgggaaacacactgactgggacccagagcttcaggtgagtcagcccttctgggcctcagttttctcatctggccagagtggactcggggcgcccactcacaggtgatccttatgcccatgctgggctaaggtctcctctaggtggctgggctgagctgccagcagtgtctgtggccaggatgccctgagcagccccaggggtgtgctctctcctccctctgcactgggacgggactgtgcagccagcccactcacctggtctccaagtgttgctcctgccaccgaggcaggtgaacctcccccaacactgtgccctccaccagccccacccccagggctccaagcttgttgtgcccaagcagcggcgcccgttacctttggtctggctactctccatggccccatcctgctgcttgcctacaatggaagagggatgacagacacgaaggcttgaggacaccagcctgggggccgcgtggcagagggggtggggaggaggggcctgattgctggtggccttcttcatgccccgtcctctccaggctcaccccgtcaccacctcccagcacacggtcaccatgaacactggcattcctgagccagacctctgcccagggctccccttcggccttaagctcagccctacagtgaacccctaaagccagccttggaagggccctgggtcacacatggctggcagtgggaggttcccggaagctggaacctccccaagtcgggacgtctgctccctgcaaaccagctcaaggggttcacttagatggctcctaacccctggaagccaggcagacagcacccagctgcccttgcctagggattggttttccctgcagtcacgtccagcagttagctcagtgtgtgtgtgtttgagcactgcaacctccacctcccaggtttaagcgatcctcctgcctcagcctcccaagtagctgggactacaggtgtacaccaccacgcccagttaatttttgtacttttaatagagacggggtttcgccatgttggccaggctggtctccaactcctgacctcaagtgattcacctgccttgacctctcaaagtgttgggattacaggcatgagccactgtgcctggccccagtgtgtgttttaaagggacaaaggaatgagacgctaggactctgcggggcgctttcaggtcattggtcaacccagggctgcagcacaggagtgccagcctgagccccggcacacagcagccctgcaaggccaggctgggccccaagtggccctatccaggggctcaggtggtgggcacagtcaccccttctgagagctgcagttagaggagcttcctgggggccacatctgcactcccaggcagttggggttgggatccggggtccccagggagcagggagggccccccccccgaccctactcagccaggggtggggcattgatcaggccctctccgcccagggttcctgtgggcacagagggcccttcttgcagggaggggagacccccacggacacaagatggcagtgcgatgaccgcacagcacagcaggggagatggcagagccttggggccgtgggggcccgaaggaagcatggactctggacccagcctgcacacaggccctgggaggcctctggaggagggaggcagggggaagtctgggatgagcattgctggaagaggagggctgggccccgccagaagagacaggagtggggggaaggtgaggaggagaagcacacttggagaaaggtgcataggagtcaaggtcaagagacaagaaatagggggttgggtgcaggtagaaggcaagtatcctaagcgtgtacctggcaggctgcgccaaacaatggggatggggcgggagagacggggagggcgagcagggagccccctggtcttgctggtaccctctacccagctggccagctgctgctctccctccagggccccctcagggttctcttcctccaggaagccctctagctctgactcctaagtaggacagcctgagggtgctggagaggagggccaggtggggcctgggaggggctgaatggtcttgtcaatttaaaaaagaaaggagaggcctggaacagttaggaaggacacactcatttaaggtacagagaaggtgagcagcctgagaagggcggctggagactccagaggagcgtgggttcccgtggacgatgggagagggccattgtgtgcaagacatgaggaggcagcccaggcaggggcagctgggcttcccaggacagaggcctagggactccagcccagcccagacgaggcccagggctgcccatctgcctgcgcacccccagggcactcactggggtgagacactgcactgagccctacaggacttggtgccacaaagaagagccggtgcagggagacacaggcccaggctgccaggaggcagggctcgtcgaagcttctaggccacagagggtcatccagctactcctttgctgcctccagggagctttgggctcagggctgaccttttccccgggccctgactgcccgccccacgcccccacgcccccacaccccgcgcactggccccagggccctggctggaggtcactggcaggaagcagagctttcccatgcgggtgtggctccctaccatgttttggctgcaggagaggccagaaggcaagtccaggccagagcaaggctgcccagccagaaggggctgtggcagccattcaatcttgtccatcagggcctccctgaatagtactcaggttagaaggtctgaggactccgcccgctgcagggcctgatggtggcagctccagccacaggacgaggaatgggccctcctggctcgggcttgcctagctttgtaagccccagggcagggccaccacccacagttgggctgcccggccctcacctgtcccagcctcctctgacctctgacccccacctccctggctgcctcccacgctggcctgggatcctcggcaccttactgggcacgggccctgagggtaagcatgaggctccccgtagctcctgtccctctaacgccattcctgtccaggtaggtatgggatcccggagcctttggggatggtggtctcagggaaactccccgtccacggcactggaggggcccttggcctgccggctctcaggggggatatcctcagaagaggagtctccacggagaatcaaaagagagggcccggcctcccacccacttgggctggctctccctgagcccccagtggcaccggcccgcaaagaaagaatgggcagcgtggaaggagccgccaccagcaccagggactggcggcactgctgcgctacctttcttatctttcttctcttcctcctctccgccagctccaagcagcgtgaagatgatgcctgtctgggaattcacgccaacggcggtcaccaccattcttccagaaccttccatgacatgagtgcctggaacagcaacacagagactgagacaggaatttgtatcacccagtgggagacacattcagcgcccacaacctgtctcccagggtctcccggaagcagggacgcggtgtccaccttaaaactaggctgaagcctcctccctggcttggaggagaccccgaggcccacagggcccacctagggcctccagccttcctgtcccgtttcacactacgtttccaactgggataaacaccggactatgctgaaaccttctggaaagggaacactacccccactggatattgtcgagggtctggattgagagaagcacagcgctgtgctggcccctgcaagcctctccgcttggggcttcccattcaggacacaaagcactctcccgggcctggagggccagcttcctcgccctgtggctggagctgccaccatcaggcctcaagacgggcggagtcttcagattcccaacctgaaggttatgctggaaggccctggtggaggtggaggctgagcccagcaggcagcctggacaggatgctgggccacacggctgctgacgccccttggtgccaggctggcccggagggtggccctcacctgagagcagcatgggatctttgtcagctgacttgcgcacgtggtcagactcgcccgtcagggagctctcgtcgatcttgaggtcattggcctggatgagcacgccgtcggctggcagcaggtcgcctagagcaccgggaagcagaggcctttctccccaccgcctcctcccggctgccccaggggaggtcccgtcaggtgccatgggccgcctgggaaagggactcaggagccctcctccttctggggaacgaggacatttgcatcctttgtaggggggaaagcccgccgtggaggctgtggggacagttgattcttcgggggcctgctgtgtctgaaaccactctgccctgccccgtgttcccccacctcccccacccccgccacctcccgcctcctaaggcaggtgacgacacgcaggccaccggggagaacctgtgctgggggtctcctctggctcaccctccccagaagcaggagccgagcttccttgacagggtgggtgaagaccagggcactcaccgtacttgacctgggcaatgtcccccaccaccagcgcagccacggggacctggaggagctgcccgttccggatgaccgtgaacttctgctcctgctcaattcggctctgcaggcctcggaactgcttctccttgctccagtcattgaaggccgtgaccagcaccacacagatgacggacagcaggatggcagccccctcgatccagccagcttcggcctcgccctcatcttctgcgcctcccgacacattcccacaggctgtgcggaggacagaagggaagcagtggaggagacatcaccatcctgtgaccgtccctcatctcaagccccattcctcttcctccttccagcccaggcccccgggccttaccttcactctcctctcctggcggcgcatagaacgagaggcccagagagacgatggcagccacctccaggatgatgagggtcacgtcctgcagggcctcccacaccagctgcaggaaggtcttgggttgctttggggggatgaagttctgcccgtagatctgcctgcgcttctccaggtcattggtgttgtccgccaggcctgcatggtgccccggaagcacagaaggggaggatgggatgggacgggtcggccttgtgtgtcccaggcctcctatgtggccctgactgactgctcctggggtggcagcagccctctggggccgtctggccagcgcctggctctccctctagacaggagcctttctgcagactgctgggggtgtgcacgtgggagtgagcatgcggctctctggctgctgtcatggggagtccctagccatcctcctcctgacacacagatgacaaaacaggccaggaggctcctggactccagcgggtcccaggtccctgtgctttcctggccacctccacactaccgctgagggggcactggaaggcaggggacaggacccaacaagggggcacagaggggacccagcagggtatgtccaggtcaacaagggttgctaggagacaggacagaagagtatagccaatggtcccctggggaggagagcgagtgtccaggggactttagtggagacatggggagggccaccaatcaggggaggctgggatggcaccagatgccaaagactaggccagggctctgtgcctgtcaggaaacacctctctagctcccagcctatgaattccctgagcaggcttgtcaccaacacccccctccccagctctgtaagatggggccagccggtcccaaagactggcagtgtcacacagcccaacctgtgggggcagggacagcctgcaaagagggtgggcagggcccgagggattggggcatgagcacggccagtgccgaggaatcagcagtctccagggtgcctgtggctgctggcaacagggagcggaggcttactttccagaagtttctcggggaagaagcagtggggagggagcatgagagctaatgggagatgcaagttcttgggtccagagacccaaagaagaagaacggtgtcacgcgaggagagagagaggcacgggaatgggagtgggttcctggtggggaacaggcggggagaagccaaaccggagtcacggtgctgagggaggggactgggaagtcttcaagccttttctgggctgcatggcctcgcaggggtcggggagacactgcccaccctgggctgctcatcagctgctctctgcagggtgcagacaaggccactgaggccggaggtggagagggccctgtaaccatgagtcagagctctggcctgtggcccaggtcaggacagaacctacgctgcccgacaggacccggtgagcacagggccctcaggacccagcagccttggttctaatgcaactccagcaccaactttgatccctcagccagggctcacagcttgtctacatggcgacttgaatgacacccaaagccactcagaagcccccaaattggctttgccttcacaatcagagccacctgtccctatccaattctgtcacttgtcatccttgaggacgcttacttctcagtcttccttggcctgaaggtactggaagcttacgtgcgtgactggcatccgggcctggacacccactcagccaccttctaccggggcaggcatgtgggatgacaccctcctctggccccacccttggccccaggattctcagccccggctgatcccgaggagccctcccgggcgctcacccggcgcccagtgctgtcgcggccgtgaccagacccacactgacacctggtggacagacagcagcttgcagctcccagccctgggcagctgggctcacgcctgccatctgctgcagggacgggatgaccagagagcccagccccagcccatggggcactcacagtgggtctgggaaggcacacaagaccctccagatgactggagaacaggcgcatgctaaccttggggcttctgaggaggggcaggggtagccctggccgcagtggaacagaagctgccgcccgcacaaccgtggctcattcaccccagctaggcgacggccacatggcgtcctccccacccagaagagccgcagctgtccgtgcctctctgcccctggctcaggtttcttcaggagccaaaggcctcttgctgaggcccgagcctgccccaatcgggagcctggggttaacgcacgacctcagctcctgggtggtggggagggggctggggaccagggacccaactgaggggtgtgcacctcgctctggactgggactgtctcctggaattacaggagctaagccaggtggggacagtactagggagtacaagaccccccaagtgacttaagaagaagcacgtgctaaccgtggggcttctgcggagggagaggagcaggggagggctccccagacacctggggtctccactgcccttagcctggagcctccatgcgagtctctctcctgcctgcccctcctcacatgcccagtttgtccctgagagcagccgggacccctggcccattccccaggagctccctcgccctcgccagcctctcccttggccttgacctgcccttgcagctgtagccttgctcgtttctccttagccttcctgtgggctcggggtcccgacggctgccccactgcagcacccattgacggggaggaggaacacagctgcggcccctctggctctgagcacatgcttccccagcaggcccgagggcagtccaggtccagggcatgggggcaggggctggccggttggcatggacacagatgggcggcctgcccggagcagaggccagatgccatcagaattggattaggagcatctcgtgtcggctcccagcgaatccgccccctcctttccagaactgcctgtggagcccagaggggcactgggcggggccaggttcccgggcgaacccacctctgagttcagcctgagacccaggtttcctgacaacagcagcgcggtttccaggatgggttctggaatcctcttggagtgctcccaagacagggagggcagtggattgatgagtgtaccgccagaagataaagtccccttcccgcaatgcactatgcgccataaagcacctgccccacgggggagtgcctgcctcctgggcagccccacgtctgcccaccttgtcaggggattggcatggggcttggggcacaacaaagccagctgcccccgtggctcaggcccttgtgtctgaggaggactgaggggcaggcaggtctgagcaccagggtccgggtgcacggccgggctaggggatgcggggagcgagtcacccgctcctggcacccagacagctcaagcccgacagctccagcccgaggaccttgagggttgaagaggggaggggccggtcctctgctgctcattctgtgggcagcagatccaggcctggccggctccctgcactgtggccttggggacccaggtgcttggaagcccgtcagaggccaagccacccacctgtgcacctgcccttctccgtgcccctgcctccacaggcacgcaagagctcctgagctccatggcagaatcgggcaggttcccaggggccttgacattttaaatatttaacaaggcctggcagacaggggaagagcagacagctgaggcccatctgcttcctttgatctgggagaggccagagctcttgtggataaatggccctccacagcctcctcgggggctgggcaaggaggagggaaggcaagagatgctcgggagcagagccaaggcatcagccccagcagcagctgcaccgtgagggcgtgtgcggcggcgaggccgggtgtcacgggcgcatcagctccagggcacaaagctagggagacccaggcagaccctggagttcctgacctggcccgcagcccccctcctccatcttcactcctccctgcagcctgagtgccacctgcagacagacggggccgaggccggagccacaagagaacagtctctgggttgagggtgagggcagagcgggaggctggaggtgccaaggagcctcacggctgggagcagaggagatgggtgggcccaggcgttgcccagatgggcagcagatcaaatcagcccgcactggctggggaacaggcctggcactaggctgggatagccccagcagccctgccaggcacgcagcgccagagaatgctgtggctcctggaatctggggctgggcctggctcctgggggtccccgcttcatggcagaccgcagcaaccagggctgggcaggcctcacaaggccgggtggaacattgcctcccacagggatagtcaggcctccgccccagatctttctagacagtgctcaccgggctttctagagcctccctcagcagtgagaccgacactaccctgggcttgtgcctctttgggacagcctgtggccagtcagtgccacctctgatcagcactctgggcctcccgtgacccagcttcggtcaccccttcctgccagacccaaatggcttgtgccatccccaggccatcctctctcttcccaggagaggccccggtcacccgaaactccgaaggcttgcaccctgcatcccttcctcctgttctgatcccccttaagtgaacacagggttgagcacaccggaaatccccaaatatacagatggggctgtcttcctcctccctgccctgccctgccctgttcctcggaagggtttctgtttggggcccattccgcctgtgtgtgtgtcccatgaagttcccatctccccctccccagtctcgctctatagagcggagaactcctgattgtggaggtgtggagatgagggggtcaggtcaggttacccagggcatctccccctcaagggaaatggctgagaggaggggcacaggtggcccttgaccctggccagccttggggctaaggatgccttcaggtcgctcctctgaaggctgggagcagggctgggtggcatgcagcctgagagggacttaccctctgtgggtgaggtcttcagcctccggcagagcccgctgacatccccgtaggcctcctcgatcttctgcagcgcctcggcccctcgcagctccatgagggtgcgcagctccgccagcgtgcacccaaagcctccagcctgggggacatcccgctgctgctggggcttggggtggaactcgatggaactattggccatgtcgcccatgctgcctgtcaggccttctcacaagtgcaatcttggctcagccacagctagggacaggcggccacccacggtcccagtgcccaggcaaggtttggcggcggtgagaaagctgctaagcgtggacacctggggagatggaggcgagaagaagccaggggagtggttgagacaaaactgaggtcccatcttccagaatattctcggcaaatcttcactcagtctgtgccatgaccctcgaagtgcagaaatcacctcccaggctgggccagtggccctcatgctctgccaggccccaccagccaggccactcccgggtcctgcccaccatgggtgcccagaacctggagggcttgcccaggtgggggaggggaagtgtcgatgcctcctgccaggaccctgcagtggttaacactagctagctggaggcagaggctgtcactgccccccagatccattcgggaacccacgctgaagtgagggcagcgtgctgggactgatcagtggctggtcttgcccgcgccccaccaccagtcctgcgcttgttcactccggttcactccctgctcttgcctggttaagatgcgccctgtgcagcgggcatgccatgagtccctggtggtcttctggtgtggccttagtggctcacggtttctgtggccctgagagtacctggggggccaggggcgaggaaaggaggaggcccggaggaagggtgggaaacaggggaggggagagagggacaagacggaaaggcaaagagagggagggaaagggggatggagggagggagaagagggaggggataaagggagtggctgaggaggagaggaggagagggtacacaggagaaagccaaagcagccacaggtcgctggtgagtctgccaacgtcccagcccacagcatggtgccacccactcccctccacgctcttcttccctccagatgacaaagtaaggagccaaagtctccccacactgaaagcatccaggccacggccctggccccactctgccgagcatcgcaaagttgtcatccctctccctgtccccgtcaccttacccaaggatccgctagggcccaggctgccccttctgcagccatcacagtgtttggcggggcccactgcagctcctctctctccgctccttcccggcccgagctaagcctgtcacatcctcatggaactgaaatggcctcagtgcacatggcctggccttgacatcagccaagagccctcctggcagctcagcagggccctgaacccccgtctctggggaagctcctggctcagaagcatccgttggaaacgagtggcccagagccctgaagaaaggggagaaagccctcaggcagccaaagcagacacggccaagtccatggccttattctcaggagaggccctggtggatacttcacgaaacatccatccacagtgacccatgtttgaaaagcgtgggcacctgcgcgtttactctcgcgacacattgcacatgaagcagccttcacttctgggagatgtggggacaaaatgatggccatgtgcctgtgccgtcctctctccccacctctccccgccctgtcttgcagttggtcacctgacacatattcaccgagcagctactacatgcctggcactggcttgatgtgctgggacaggtgctcaacaagtttcaactaaccccgtccctctctagctgggacagggagaacagcaggcccgagggccaagagctgtggggttgcagctggggcaaaggtgaggcaaggcgtctggggacaggcattggggggaaaagactagaaggagtgaaagctgaggagagggggccaggacagcaagcgaagctgtcccaggtgaggcgggctccttctgggggtgctgtgtggacgaattgcccttgcttttctgatgcgggaaactgaggctggcttggggaagtggcagagccagaggacagctgggtgtcccacttctgacccctcaaggcagcaatggcagctttcggctctcacctggactcctcgtcttctcgagacagcctcccctccccaccccaggacctttgcttgtgacggtgcacctgccagggcgccttctccctgccttcctgagctccagtcacctcatgcctcaacaatcccaccatgtagcaactttgtgccactgtcaggttcaggctctgtgcccccagcgggtgacagagtgaatggcttgtgtggtaggctcttgggtggcacacggccatgacagaaatgcttgttcctcagagcaggggttcctcgtggcacggtcaccgaggcctggtggccctcccctggcatgtgctcatcctccctcctctgaccatggcatacccaaggccagctctgtcctcccccacccggtccctgcccctgaccccacagcggtggcccagacagaaccataccaggtcgtacagctgctcctgactggtgcagccatggctgtgtctgactggacccacagtgactcatggggagggcagtgggcaaggaggcagtcctcccctctgccatggtcccggggccaacttccttctcctcggctggccctgctggccctccccactgcaggatccccacccctcagcaagcaagctccacgtcctgtggaccacctcttaggtctctctctagtccagcaactggtcatgaccctgctgtgagtcaccactttcctggttcaggcaccatcactccagcgagcccctgtttcagtctcccatccccatcaagcaaaaggccagattccttctgagcacttcccagccccactcccaccccagccacacagccctgccagctctgagccccgaccgcacgccctctgttccagctccacctgctgacctccgatgaatcctcttagtcacaattcaagtggaacattctccaggagtctctgccagttccccagccaaaactgattgcgcctgagtctataatcccgcgacccattcctatttcactctgcttggcgctgcgatgatctgtgagcttgtctcccaccagctgggccctaagctctttgagacacgtggtatggagtcggcaggaagtctaccgcgtggtcagtcccgcatgtggccgggggcctggaggaatgagtgaatgggggcctggcccacaggggaggaacttggagtcctgggaggtggagtctccatcctggaggacagggtggggtcggggtgctctgctaaccctcactgtcttcatgaatgcaacaggctatagggcagacaggatccatcagttagagtaaggcccatttagagcgactgttggctgctgtgcagaccaaatggcatatactttgcttttctgggttctatataagcctgggcggtggcctccctgaggcccaataaagacagcagccatcgccgagatggccaagaaccgaagtgactaggcctatcagttctgcaggcctgacagagtttccggcctgggctggctgccgagaatggtctgtaggcaccaaaagggcagggaacataccatttctgtgctctttcatctttctgaccttaattggcttcattgaaatgagaacctccacagagggggcctcgcaccttccggcatttgcaccatccccgcacagactggccggcctcgtggtgggagacagccaggggggtccctggctgctgcctccaggggctgctggaggggatggcccaagtccaggcccattactcaaccgccttctggactcttctcttcagcagggcccagagaccctcacctcccaactaggctcagagtgcctactccccacccagtgactcaaacccacctgaccagagacccaggggtcctctttcccctatgttgtccctccctggctttgggggctctgctggcacctccagcttagtcccccatggacttcctccaggccctgggcagcccagcatgctccagaaggctcggcactttctaagtagggggcacccccgctcccatggggcccctctcaggaccccatggcacacactgagttttgagcccacatctgcatgccagctcttgacagacatgtttctttcactgcacccttggaaacaccctacgagggccaggagaactctccctgccttacagagggggaaactgaggctcaggaagcctcctgcttttgccctggttctcccagccctgccttccatgtgacttgaggtgggtcatggccgcccttgctgggacgctctgatgacacccctgaaagcctccccagcaggcccaggctgcattccactcggccacctgctccgcctttatggaggagagaacagatggagggcgagatcccaccaccgtcctccagatctcaggtgatgcacgcatcgggattcacgccattctctttcctgaaaacagccccactgcaccccagtcgagcaccccttcagtttctggggtctgcgtggacatatatccccacagggatgatggggcatgtactgccaggaagtcccagctcccgagtcactccctagtcactggaccctcagtgatgagaacatgcggctcctgggcattcagaccatctggaagccagagccaggcccaggatgccgtggccccgaagcaagaaggaagcagaactcaggggcagagggcaggaggtggacgcctgggggcctacctgggcacatgccctccaccgtgggccctcctgaaggcagactgtccgtcacctgctccctacagacccaccaagcaagggcccgcctttcagaagggcccatcactcagcgacgtgactcactacggggattccttaaaacaatagtcccccatctctctccacctccaggctcctagaacacaggccaggcccggcagaacccagagaggaaaagcaagccaaggcaacagcgagaggtgtggcccaggcctcgtaggtcaggcccggggtgggcccctagaccagctggggagcaggtggggagagggcacggaaggagggcgcccagtctggcagccaccctgccctctcctgggcctggcatgatcctaggcaggtcgagatgctggtggctggtgtgcacctgggagaccccttttatccctgattccccacatcttcctgcccttgcgccaggccctctccttcctgcccgcccctgccccctcccctctgcttgacgcaccttggcgaccacctgggaggggaaaggagggttccaaggacaaggcctgcatgcagccagggaagggggagggaaggagctgaggcagagaacagcctcattaatatttcagaggcaccgtcgctgcagctcctgggccctcacggctccacttgtgctggtggagggaggaggatgggaaaagagaaggaaataaaacccgagaaaacagatttaaagggacaggctccccctctgccccccaccggcccccagtgctctgttccttcctccccctgttcctggtacaatctgtacacatgacaagtggctctcatgcctggaacagctttgggcaaaaacaatagccatcaccatggcgccccctccccactcctgcatgcacccacctgcctgaagctctgccctgcagggcagccccggaggggccaccttggggacccactggcagctgcgtgcaaagccaaagcaaccgcctgtccggcgccgggtgccgcagaaagacacaggcattggaagtcctcgttaacaagggtccagacaaggaggattctggaacccacagaaacaccctggaggtggcaggagcccaggaggttgcccgattcagcctgcgcctttgggtggatgcacttctgcagcactcctggcccctaggtggcccagcgctctactctaatctacggcagcccatgccagacctgggtgggcacccctccccactcagggaacttcacgaatacagagtcttgggtccagagcttcccattcagaagcgggaggaccagaacgctataaagcaccccaacccctgggggatctgggtgtctagtcaagctcgagaccacacatttgcctgccttcagaggctccagggctggcccagaattctcattcaaacaagcaccgccatagaatggaagacggtgcagccactgtggaaagcagtagaattcccataggacccacccaccccactgctggggtaggccccaaagaattgaaagcagggacacaaacgtatttgtccactcaagttcatagcaacattactcacaatagccaaaaggtggatgcaacccaatgtccatggataggcagctggataaacaccatgtggcccatccaggccatagaataggactcagccttacaaagtaaggccattctgagacgggcttcaacatggctgacccttgaggacgttggactcagtagaaggagccagtcacagagaggccaacactgtaggattccactcctgtgagggcctcataggagagctgtgaaatctgaggggacggacagtggaagggtgggtgccatgggctgggggctggggagttggggttgaacggggccagagcttcagtttgggaagacgaacaagttctgcggctggatggtggtgatggctgcacagcaccatgaatgtgcttctgcccctgggccgcacacttaaaaatggtgaacgtggtacattttaggtgatgtctatgccaccacaatagaacacgcaagcagcccccaccagccacttcgccctgtgtccagggtggtggacactgggcctgaatggcctcccgtggtgcccaagccacacgccgtgattgcaggagtttcactgccttgaccagcccaatcagccagcagttcgcttgtatggattttaacttccaggaaacccccctactggatatggaaacccaagcagacccttccccacacaccctacccccaccctgcagcctctgtgacttttaacaccacccatatcctgcccagccaggtgggtaccctatttggtggcacaggagcagatcagtggagagaggccatcaccactgctcctgccctcttgctcacaaatggcccctctttttgctgcacttcttcagaggtactgaccccattccatccccagaagggctggccaggtcacctggggaaagcctggcctcaagatgggtaccttccacttctcaaatgtgtcttgaggaggtgttaatgaatccgcagaggtgtgtggcagaaacttgctagctactctcccacctcctacgtcatgttttaattttcagctaagtgtcttgtcatccagctaatgattacattcccccaactcccttgcagctaaccatgaccatctgactctgtcctggccaactgggtatgagcaaaagtgacagggacgaattcaagggccatgtccttaaagagaaggaatgtgttctcctctgcccttcccctccttcctgccagctggaatgctgatgtggggacaggtgcggccgcagctatctatctgttgccatcttgcacatggagtccatgtatgacacaatcaaaggagctcagattcctgagggctaagtagctgttgcgctggccctaggttgcccacctagactcttacatgagaaagaagtcaattctctctcactgaagccactgttatgctgggtctctgttagataggccaagcccatagcctgagtaaatgttcactcctaacccaaatccagcctggttctgggagagccaggaggcctccctgaggtctccaggacctaccaaacccccactttcccctgagctccctggggggtgatattgtcctagaagttctagctgaggcagaagggagatgatagagccacggatgagaggcagaatgactatcactctgccagcagcctctatagcatggggtggccctccccaccaaagagcacatgcggctcaggcacagagtggttagagagcctactcaaggtcacacggcaagccagaagcagaggccaacaggacctcaagtggtctagctccagaggattcgacattgctgctctgccaagttatactgccctgaaaagcccagaaaagcaacgagcaagtgattagaaccaatgaaaagagttcagcaaagtgactggacaggaaatctgtccccatcaacctcagggttccagagtgcaggtgctggctttggtcactcaagctctctgggccttcactttttaatctgcgaaatggtcctcgttcctttttgctgggttggtgagaaggcagggctccacctgcccacacaccctgaggctggtccccaggggactgggcccattttcccggaggttccttcaagcccaggagatctccaggaagccgagcagggcaatgctcttcgctgagtcagcccctcccgccacacgctcccctcccgaggcttgtcctgaagtcttcagctggactccagctggaccccagagttcacaggtcaggaccaagctcgaccggtgaagtcagaacattccgttcggccgggggctgaacccatgtgcctctctggatgcttccccaagcttgcccggactcccgcagtgctcctgtctcccacacaggcggccctcacaatgctgggtgtccctggatcccacggggaggttggaagcccctttgtgattggggccagaagtctacactgagggttgggggacagtcatttgtttcctgccagagaaggcaagagctgcagaaggagagagcgagggagcaggaagcataatgacactaattatccaattacagcgggtgtgcgagctgcatagcagcgtgagcctggccagccactaccctgcccctacgtgctccccacgcccctcctgccagcccgggcctgcccagcagccccgaaggcagggacggcatggggacctagaaacgctgtggctgtggccagcgtgaaagactctagcctacaaagggacggagacctcgtgtttggggtccaatgggaagccgggtccctgtcctcccagcccttcatagccagagagcacgtggatgggaggagaggtgccccaagtcggcccggctctgctgtggtacctcggtgcccgtcccagcccgcttccaatctcagagccagctctgaggaccggaagccgtcggggcctaaataggtaattaaggaaattacaggcagctggaggccatggggctgtgggccctgggctaagtccttccagcttggacaggcagtgactaaataaggagctaccaggacacatacacgtgtcctcctagggaacgagtcccatggggccccattaggaatcctggcaggggcagtagagagggcatcctggtttctggaagcaggccaaagtccttgggagtacaggctggggggatgcattggtgtcaaggtcagaggccaataaaaggatctgggaggcagacctccaaatgggggctccaactgaagatgggagtcaagcctgcccttctgtgatctagacccaaggaacgagcacaccgaagtatccgtgccactctccccagctgagggggcaggatgcctgctgccaaatgtggtgatggaggaagagccagtggcgaggatgcccagagagagggtacctcagaagctgcagccgaggctgcaggacgcgaaggtcatcaagggcttggctgctgtctgaatcgcgtgaactgagcattgctggttcatttttgaattttgcctaagacactatttctgagcgaggaacccggcatacgagcccaaagcttttccagcaaagcccagaggaagcaccaccaagttcctgccgtgctccaggagtgcctgaagggagtgcagaggcagaggccccctctcaggccgggacccaacaccaacacagggctccgagtctctccctcagtgcgccccacagcccatcagctccccctaccctcccaccaccagctgctcctccagttcctgaccctcttatcatcatctgtcatcagcaccattcctcccgccccctctgtgctcatggacagatgcctgctctccccactgggaaggcaccgggagagcacagctgggctggggacaggacctgaaggggtggatttctgctctgtgtgctcaccccctcccctcctcccttaggggagaccccaaccctgcccgtctccatctcagataccccctcccacgattgtgctatagcccagcttcctccttcggggaagggtggatggggcgcagagggccaggcggtggcctgggagccctgacccaccccatcccacctacagacacagccacgagtgcctccctaggggctaccagggcaggcgtctggggcagtggcccccaggtcagcgcattcttaccctctggccccatggatgggttacaaggggggactcttgctccactccccaggacagaggtttccaagcctagctgctggtcacagtgttgtgggcagatgaaccacaggccaggagggagagatgagactaggtgggagacgtgccctacccgtccacagccctccctcttctcctgcaccagacgtgggaccatctgctggcagccgccctctgactacaggaaggtacccagagaccccaggagccagaggagccaggaccagctgctcctgagcccatctctcctgggcctgtggctccaagccaagatgtggcagtgtctggtcctggatgcttccaggagaaatggagctgaggcccatggtggggggcggaatggacccttgtgcctggtgagcccttgctctgcccgagaattggggctggacacactctcctgctcctgctgctctttgagggagccaagcggttactgccgggctggtccaacctggagaaagggccccttcccatttggtcacgccctgtgccaccatcacacccctggcccgcaatctgtgggaatgtaggttcagtttcgaaccggccactccatgcgccttaacccggttcagggtttgatttgaaacgccggagtgcagggaattctgagtgtcaggacagtgatttccaaaagagcagcagaaaggcctaagtcctgtcatttgaggtcatcttctgccggcccacagtggcttcccaatctcccgcgctctcttgtactgccggctttgttttcgtgtttctcagtcaggaggctgtggcgttcccagggccgtctggctatcctcagctgggggccttcactcaggatggcgctgtactgcccacacccgcctcccatctgcggagagtcaaatccacagcatctgcacagagccagccgccaccccaccccatggggaccggactcatctgcggcttcggaactctgaggatgtccagagaatgtatcacccagtgctttatcttggcggggagggaggaagggggtcttgacaaagtggttctgaagtccactggacagagaagcaagctttaggattgctgaggtggggccggcaggtcaggtattaaatgataccaggtacaagaggcaaaagcacatcaccggtacagcagcacacagatgggcccgtgggtcaggacaggcagccagcaccaggtctgactgcagaccagtgtcagtgcgtgcaaatgagccagggaacaaccgatttgctactagagatggggacaactggttagcaatctgcaaaggatgcaccttagatcctcacctcaaactatcccctaagacacatctcatttggattcaacaggtttggcaaattacagcttaagtgccaaatctggcagcccagtgttcttgtgaataaagttttattgggacacagcctcaccccctcatttcgcattgtctgtggctacttgcaggctaccatgcagagttgagtagtcgggacagagactatgtggcctgcaaactggaaatctatttaccatctggccttttgcagaaaaagcttgctaatccctaaattaaagagttaagtatcttaaaaatgcaactacaccaccccaatacacacacacacacacacacagacacacacacacgaagacacatggaaaactcagaaatgaacagctctcaaatttccgaaagggattttctaagcctagaaacaatggaagaaatcacaaataattgtgagcaacaaagtgtttaccttttgcatgaaaaaaaaaaatggcaaagaacaaaggtcttaaaaattatttgcaacaaatctgttaaattgtcactgttttttcatgcatacagtttattcaagcccacagaagaaacactaagacttcaataaacgcctttcattccagcactttgggaggccgaggtgggtggatcacctgaggtgaggtgtttgagaccagcctggccaacatggtaaaaccccgggtctattaaaaatacaaaaattagccgggtgtggtggcgggcccctgtaatcccagctactcgggaggctgaggcaggagaatggctcgaaccctggaggtggaggttgcagtgagctgagatcgcgccactgcactccagcctgggtgacagagcgagactgtctcagggaaaaaaaaaaaaaaaaaaaaaaatgaagggaggaacagataattcacaaggaaaagacaacttataaacatgaggaaaaacgtgccccctcatcagcaattaaagacatataaagtaaagtacatatttttgacctagatacttatgacaatttgtttgattaaaatatctaatgctggcaaggttgcagtgagcgacaccatgcagtgcgatgaaaaagcccttttggagaacaatttggcagaagatacctctgcctgggccctctcctcaggacagaggctcctcagcagagctcacgcataagagcaaaataaatctgactgcctgggtttccaaaaatagccaaataattaagcgaattacaatctcttgggagaatattattcagccattaaaaattgtaattactgaaggccgcctgatacatcccgggtgcttggtaaataactgttgaatgatcaaatttcttctttgcatggttcaagatcattctttctttttgcaataagcacttactgcttttataatcttaaaaaattaaactataaccattttgaaaaaaaccattcatttaggaagggattatattaataaagaaaatgcttatgtgaagtaaaaaacagattacacaattgagcccatggtataatgacagcaatgtgaaatgaatcaaatggagatgttggatttacatttgcatgataggatggctttactacattttcgacttctctgtgttttatacgtttcctatagagagcatattaagagtattgtttttaaataggaagaaatcaattaaaaaaaaaaaaacccacgtctcctccctgctgtttcctgagcacaggcagtgcgctgggcatatggtggggcctaataaggaccaggcggtggccggatctggtttttgccccatgctgggtgtgctaggaccactggagtcagcacgaggcgaggtctgggcatcccccacagcacggtgagctgctgggacagaggccctttccctcctccctggtctgtgtttgtctaggtatctgcgcagcccctggagagtacatgcttggccactgccttccaaggaggcatggggcagtgggcttggtggggggtgtctaggtccgtgtgaggactcgggtctccatttgctccaaagcagctctgtgtgacagtacatcccggagtctctgcactgtcccatatggtagccaccagccatgtgtggctacctgaggaggcggggtcagggcaggatgggcggggactcaggttgtggacccgagccctgggagataccggctggcctcgtggcctcagtccatcctcccggccccagccaggtttgcactcttactttggtgaacactgagcaaagcacaaaggctccaggagggcaggaagggcattgcgtttgctttttgctttccgtcgtctcccctgaagcaaacacagagcctggcacacagtgaaccagggcagtgtccctcatgcccatcacatcaataagatgtggccccctggcatagctggcgccattctgacaatagaatgcactcatccattctgaggaacgacccgttcaagcccagcctggcactttctgtccctacctgttaagctctcagactggagcctgtcccaccacagaacacctcttcaaatttctgtgagcagtcagccctctttggggcttctcttcaggatggttctctgggggagcccaagctgctgcattagtggccttgtgccaccagggagtgggtgtgggaggtggcttcagggtccgtgtgaggacttgggtttccatttcctgtagagcagctctgtgtgacagagcattcgggagtgatggaaatgttctctctctgcactgtctgtgacggtagccaccagccttgggtggctcctgagcccttgaaatgtggctggtgcacctgaggaagtgcattctaataaaatcgctgcttggacagtgcagctggagaaagtgccttgagcctgtggcctcaggggagaacttctcactggaataaaatggttgctcgcttactgagagacccacctacagaacaagagaggctggctcaggacccctttaaataaggtgctcttcaaggacacggacatactcgctttgtacaactttgatttggaaccaagactccggaaacctcctcgtgctctaaaagagtcctgccagtcccaagattccccaaccattggcatttccacccttgccttgttgctctgattcaagtcctgccacctactcagccatgtgaccttggacttgtctccttcccaaccttgggcagtccaggatgcccgaattcccctgcatttgagagcctgcttccctctgccccagtgacgcgtggctctgatccttctccgcaggctcccaggcccactgccagcaccgcccacccaacagaaggagcccaggcaggggagggctttccagccaggcgctgcttggcctggcttctgccagcttagccagggtggggaagggaggagccctgtgcatgctccaggtctctgcctggcatacccagcccggggcgttgctggggagcttgctgcaaagtcacagcaagaggcttagagggaagtgtttgccttcagtaccatggcacaggtccccatctatcagctgccatttacgtgcactgccagtgcttccgggtgccctgaaggggccatgaatgcagagctaaaccggtccctgagttgctggagactgatataaatccacctgttgtccatttctctcagtgggtagacggggcagaggtgcaggtggctcagcttctgagctgcaaggtcttcccaagaatccccggcttcagcccacaaggctgggagtacccgagacagtgagttcacacgaaccacactctactctgctgacttccgcacacacttctggagatacaggaactaatggctacaagcacagaccagactccggagcctgatggactacattccagccctggatttgctacctactggctgtgtgaccttgggcaagttacctagcctctctgggcctcagccgcaatgcaaaatggggataacagcacttgcaatcatttgttgttgtttcaattaagtgggcaaggaaatgtctgtgcagcactcagtgtctgacataaagtgactgccattataactattatcattgttgacattacttgatgtgctactgaccactgatggagacagtggccattggtgaaatacacaagccatcagtttaaaatcagaggggagttcatatgtgctgatgacttgctctgtgaggtgggggaggaggtgaaaaggccagaagaagctctgcctggctctgctggctgcaagaggcccagagggtactcagctctcagaagcccctggggctctggggcgccctcatcctgtctaccgggcaggcaaggcgcccctttccacaagacattctcagagggtcctccacggctgaccccggcactccgtggctgcatccctgggctgggagcagacgttctgggatggagagcactcactgactcacaggcttggcttctcctgctagtgaatgattcaacctctgaagctccagctcccccaggcccacccccaccctccctggatctggaatggagaagggacttggccaaggtcacaaagaccatcaggtaaggggctgctgtcactgaagccccaggcaccctcacgagcctcctctggccccttccttgcccctcgggggccgattggggcatctccatcacctggcattgtggctgtcccctggcatgctctttgccttaggggcttccttcctcagggaccggctctccttctggccctgtgcaaggccccctcccacgcccgccccacttccatctgcccgttaccccctgctgtgtgagagcatgcctactcctgcactcaaaccacctggccgtgcagggcacggcccaggtggagctgatggagactggctgtgtccttggctgtcccccgcctcggggcctgcagcagtgacaatcaatggccggggaccacaagttcccagcccgttccgatggcgcagacttgaggggctgacctcaccctgggaccctctgctgggtctcagctgtgtcccacaggggcccaggcatccccagccctctcctcggcatcccagtgcccctttaatgagccacatggcttcggtttcctcatctgtgaaaagtggcggcggggggtgggggttggggatgaaaacagccattcactcgtgtggttgaggtgagactcagatggagctcaggaagtggggctggtctttgattattacgataacctctccccgcctccctgccccaccaggttcataggaatgtccctagccatctgctcatgaaggaaggggcctcaattcagggctgaatcccttctcctcttgggggcctcaatgatcccatctgaaaaatggggacaaaaatccaggccttgcctctcctgttcagtgagtctgcagattcagtgaggtcaaggtcatgaatatgccatgcagaaaccaggtgcccactctgtgccaggcctgtgcaaatgaagagccagtccttgccttaagatggtcactgactagtgaggggcaatggcagggggtgagggcacagatcctagtgggcaaaggaggggaggaggtgcagggggtgcctgccagactggtgcccaagtcagccaggggaagtcggctgacgtttagggtgccagtggaattcaggatgggggccagttggggacaggctggacttgatcctttagcaggcagggactcctttgaggtcggaggccctgggcttcatctttgaaagttatatgacctcgccaggaaatggcaagcatctcgttgaggaattctggtcccttccctgccccttgagtgagcgaaggagcatttccacagtctctcctaaaccctcatggagccctcaccgcgggctctccaagactccctccagtcctgacctgccccggcgccatgcccctgccctgcctcccacccctcctcagccggctggctgagccaccaacccccagaagggccagcagaaggaaggacaccaggtcacagagagagaagcccatcgtctcaggctctgggagatgccgcacctgccattccaaattccagaatcttaaagccagagctttcacccgtgagaaaacgcaggcggccacaggaaaagctggctggccaaggtcacacaggcgaggagggggagacagccgttcctggagggatggagaagttacctaagtgcggccccgggcggcttctcgtgggcactgcccatgaccgcggtggggtctgctgggcagccgcgtgggcgtgcggggaacggtgcgggaaggcgagaggggaaggatgatacagtgtgagggcgcgggggggagggggtgcccgaggctccgggaaggtgcgtgcgcactggcgggctcccggcccagatcccgcgcccccggctgcgcccaccctgagccccggcccgcagcccccaagggccttgttcctcagacacggatgcgcgtgcgcgcgcgatgcggggcgcagggtgcagggtgcggggcgctgcccgccggcctggggccccggggtgacgcgcggccgcagtgccgcaaggacacgcaggcccggcgcggggctcaggtgcctcgggcggggacccgtgtccccctacctgccgccgcaccacctgccgggtcatcctcccatccccacccgcgccttgtgcccgcgccgcgcccgcgcccaccccggcggcgcccgcgcgcccagagcaccacttacccgggcatgggcacggccgccgccgcggcctcggctccggcgggcgctgtcgctgcgggcgggcgtcaggcgggcaacgatccgctccaaggatggaaaggcctgggcacggggcggcctggccggcggcgcgggacgcgaccctctgcggcgggcgagggctgcggccgagtgctccccacgctctgcaccggcggcgggcgacgcggcgcgctcggctccaaccgcagctctgagcgcggagggagggaggggggaggggagggagctgggtgaggaggagggagggaggagggagcgggcgcggggggcggtgcgcggcgcaggggcctcggggctcaggagctacgcgcccggtgcgcgcccttctgtccccaggacgcgcgagggtgcccgcccttcctggcctggcattgcccccaaagggcactggccgagtgggggtgggtggggatggaaactgggggaccatggcacctgtgagtgcagagagagcaccctgagcttgcgactgaggctgccactacctctccagaccctgccctctaggtgcgtctccccaacagtaaaatggggcacagagccgggtggctgatgtgtagcgtggggtccttgggtcttgcctcagtggactccaaggcattggtggtctcctgcaaactccattacctgttgagagtacgggcgtccaaatgcgtcttcccagaggaagcggcgcttaccggagatcctcaccgtcggttatcacgggaacaccaccgttaggcagaacacagagactgcacacaggtgggcaccagagacagacacgcaggggcacatacatccccggtgtgagtggagacagacacacagacaaaccccagtgcagacacctgtccacacccacaagcacgcgttcccacctacctggaaagagacccccgtgcctgccggtggacccccaggcttcccagctccaggggctgtggaggcctctgaccccagggccggcctttgcgagcattctgagcagcgagcagagaatgctcgctggggcacaggtagaggctctgggcgggagcctgaggcaggtgcaagaggcctggacgcagcctcaaattctttcttgccttggacaaagagggccctggacatgctgtgtgccagaccagagctgaatactggggacacagcagggaccacaaagcagggagtggccgtcggatggcaaatgtgctcacgccgctggggtcggagctatggaaccccattgatggggagccatgaaagaggctgctggcggctcagggaaggcctctttgaggaggcaccactgtgctagggaccaaaaggacagaaagcttctgctgcccctgagaccagggaaccgtcacaacccccacagactgcccctcccttccacaggaagcagctggtgccgtggaaagctgaggttcgcgcacgcacgcacacacacactcatacacctggtcatgtgtgcgctcacacatgcttactcacacccactcacatgcacgcacacatactcacacctgctcatatgcatgaactcatgctcactcacctacttacacaaacacacactcacacactcatgcacacactcacaatctcacgcagacacatcctcacagtcatatgtgctcactcaccctcacccacacaagctcggtggcccacacagttacacaatggttcacacatatttacatgctctcacacctacacaactcacacacttacccagtgagcacacacatgggcacatacatacacacacactcacacacagttactcacagtcacactcacacacacactccccactcacactctcacacatattcatttgcacactcccgcagtccccttccactccaactctgaggcagcttttcctgagcctggggcgtgtgctcctccgggcccagagccgccatggggacacccccttctcacacacacacagcctgtgacttcccatggccccgaatgggaaaaatcaagactgaagcaagccccaatgatgctggaaacttatcatgagctaagttctggccatttcgccagagccctgccatcttggagtcgttcctcttactagcccacattccagatggggaagtggaggcccagagggcactggatcccacccggagcaggttgtaagctggactttggcccctggccgggaggccagctgcccccatgccctcaggcaccacaggagggcagaggagctcctttccccagcgcattcaggccacgttccttcttggcctcccacactgtggcaggctccctggggtcatgtccttccatcccaggcccaagggccctgctctggagtgagcaaaggcagaagcaggctgctgagctggcctcctttcgtggcccccagcaggagcatcccttgggcaagggttgggtcccggctgaagacaagcacctcttagcagacatgtgtgggcagctctgggagggcaggtgtggggctggggagacccacacttaaaggcttaggagtggctgtgagagctgacaagcaaagagaagagtccctttgggctgcgtcactgtcttccctcggggaccagggaacatgctgagggatggaggctgttcatttaactgatggctgctatccacatgggggaatctccctgagcttggagcagctgctgcctgggttgcgtgtttatgcatctcccctccctattctctgaccccagactctgcacaggccctgtctggccagggggaagaagcaagttcaggggagaaaatctgaggcaggggctacctgccccaccactttgcctcctcccccgggcccccagggcactgctcatggctaatccagccaagagttggccatggtgcctacctttgtgatgagtcccactgaggccaaggtcagatggccaaggaacaaagtgtcatggaagtccctagtcctcagcaaattgtggcccctaaacagctaatggccaggtaaggggatggtcctttctccttggtttgtgtctgttggttcccagcccagagccctgaggctgagagggagggcccaggcctgggaatgaggacacctgagtgccaggcaaatgctgccagtgtcactggtgatccttgctcaccggccagcccctcttgggtcctccatcagtaaagaggtgggagctttgctagaaagttctcccatacaccaagtcctgtcctctgcactgggagtacttagggagccaaacccagggaggcccagaccactctgcttcccagctccctcccaggtcccaagccagcctgtcccaccatgccctggacctgcctccttagggcacgccaggcctccgtccccaccccactctcccacattgccgacgactgcctgggaaacaaaagccacagagagcaccctgctctcagcggctgcccaccgccccacctggccgcctcatccccactctcacccctctctctctccacctgcctccagccccttcagtcccgctcccctcccacaactgctttctctcctggctccttggcccctacccagtcaccaggtccgtcctctcccaggcctctgggccatgccccctccttgcccaggttccctcctgccactgttgggacagcagctccttggccagctctgaagtgaggacccctttggctgggcctggggcccccatcccgtcttctcatgcccactgtctccctggctgaggtcccagccccttccccaaggcctcaggggcaaagcccgtgtccacttgcagcccaggggcaggctaaaaatgtccccaccgatgtgtccatgtcccaacccccggaaccggaatgcagccttatttggaaatagggtctttgcagatgccatcaagtgaagaatcttgagatgtgggttatcctgggttatccccccccgccacacacacacatgctcacactcacatccatgcacggagacacacacacacagaaacacacacacacgctcacactctcatccatgcacagacacacacacacagaaacacacacacacgctcacactcacatccatgcacagagacacacacatgctcacactcacatccatgcacagagacacacacacacagaaacacacacacgctcacacatccatgcacacacacacatgctcacactcacatccatgcacggagacacacacacacagaaacacacacacgctcacactcacatccatgcacagacacacacacagaaacacacacacatgcccacactcacatccatgcacagagacacacacagaaacacacacatgcacacatacgcacacccccacatacacacacatcgtcacagacacacattcacatatgcacacagtcatacacatgcacacacaagacacactcatacacacacagaaacatatacacacacattgcacacatacacatgcagacaccccacacatacacagtcacccacacatacatacacacgaacatgctcatacacacccacacacatatgcacacgcatacccacacatacactcacagaaacacacacatacacacacattgcacatatacacacacatgtacccccccccccacaagaagccatgtgattgcagaggcaaagtggagtgaggtggccacaagtccaggacgcctggagccttccggggctgggagaggcaggaagaagccttccctagagcttctggggggagtgtggccctgagacacctggatttggacttctggcctccaggactgggagagggtccatgtcctctgtggtgagccacccggtttgtggttatccatgacagtggcctcgggccactcatccaagccccagctgggccaccgaggagctccagctcggcagagccctgtccacagcacaactgaggcttcttgggctgcttggcttgagtacatccacgcctggtggttctggaaagctggctggcgatgcagagtgtgtgtgtgtgagtgtgtgggggtgtgagtgtgagtgtgtgagtgggtgtgagtgagtggatgtgggcatgagtgtatgtgagcacgtgtgtgggtgtgtgagagtgtgtgtgagtgggagtgagtgtgtgtgagagagtgggtgtgtgtggggtgtgagtgtgcatgagagcaagtgagtgtgagagtgtgtgagtgtgaatatgtgagtgtgagtgtgtgagtgagtgtgagtgtgattgtgtgagtgtgtgagtgtgtgtgagtgagagtatgagtttgagtgtgtgtgagtgtgagcatgtgtgagtgggagtgtgtgtgagtgtgagtgcgagtgtgtgtttgtgtgtgagtatgtgagtgtgagagtatgtctgtgtgtgtgtgtgagagagagagacagagatggctctttgggcatgactcctgccagtgcagctccagcacagtcccctgggcactcctgcctgggccctggctgcccctgtgcagcaggcatcagggcctttcagcacccaggctgcccagggttctccagggcgccagagaggctgtgccctcccagaagctgagggagacaaggtctctctgctggcgatggtgccctgccctgcctgttcagagtggcaggcagggtcttggcctcttcctgtggtccctgcctcctgagactagagctggagcctgtgggagcagagcctggagaccaggccactgccaagtcctcagggcagcccctctgacttggctcccaggcctgccacctgcccctgcagccctccaaggaggggtcgtgtccctcaggggtcctgcccgcatcgtgggcccagcctgccaaggtctggctcgctgcccctttgacaagcccggactcgtctaaaccgtagcagtggattcggcttaggctcccgctgggccctgctgtgcccagaaggcacctgacctgcagcaaatgctgagaaacggccccacggcggccctgtgccctccacagccactccccgaggaagcggctttgtgacctgcattgctgtgtgtgtttgtgtgcacatgtgtttgtgcggcatatgtttgtttctgtgtgcttgtgtttgtgtgttcaagtgtgcatgtgtgcgtgtgtgtttgtgtacgcatttgtgtgcgtgtgcacgtgtgttcgtgcatgtgtgtgtgtacgtgtgtaagcccacgcctgctgccttccagcagctccggaatgctcctggccgtcaggtggtggtcctcagggtccccttcccctctccaggccacggagcatcacaaccaaccccgttctcacactacacccaatctgtcaccaagttcaggggaccctactcaagcaaagatcggctggaacttgcagcccagccgttgtccaccctaggccttcctatgccacagctggggccctgagcacagtcctactttcgaagccacttgcaagtaaatgtgggggattggcagcttgccgggagaacctccccggcacaaatgatcttccaacctcagcctcctgagcagctgggaccactggcgtgtgccacaatgcctagctaattttttagttttttcttttttagagatggggtctcactatgttgcctaggctggtcttggactcctggcctcaagcaatcttcctgccttggcctcccaaagtgctgagatgacagccgtgagccaccacgcctagccattttcttttttaagcccaaatcagtctcaccttggctagtattagctaatagtttttcccacacttggcggtagagtgaggctatgtgattcatcttcacactgtggtcaggaccaactgctttgaggatggagctcaccttccaccacgacccagaagcccttgcaggctgtgaccctgtccagctctgggctcctgcctcgggggcttggcactctagtccaggcagagtgtgtgctgcctgcagggcaccccctgctgtgtgggctaagcacgcagcctgcaggatgccttcctctgcactgaccacccatatcacactcatcccactagcttgtcctccacccacactgcatccctgagctgggacacgcagaggacaggtgtgatgaaggtgcatgaaatgagaggcagacagagaggaaaggaggcacaggaaggatgggagcgaggcaggaagagtggacagattcacgggggctgtgttggacccactgaacacagagccaatgccccaagacccgctcacagatgaatgggcggaagccccatctttccatctctgccaggccgtggcgctggctgcccctcctcccagccagcgaggggacttgcccgaagccttgactcccggcccctgcccagttcccttgcaccatgcctgcccagctcagcagacattgccgggccgtagagcacatggcccagaatagtgctgtgatgctgatggtgactttctatcactgggccaccacactgtgtggcacctcctatcccagaaaggagaaacctggggatgccagtgcgccagtgccagtccagccataaagacgcagttatgtgtgaggagccaacacgcagtgccaggctgccattcacgcgggccctgcccactctatttccgttgggagcctgggctgcccagggaagccccaggtcccgccacctgctctgaggctcttcgtgcagggccgaaggaaagtcacaggcggtagcgttgctctggggactgtccccctccaagctgtcctttccaggacgacctgtgtccccagcatgcaggctttcccggccctgacctggatcctctctctggatgctgcgtgtgtgggaatgccttgcagcccaggctcggctctgcctacacacagtgtcacctgccagggggctggcaggggagccaaggccaggccagtgcaagtgggtgcacacagcaccctgccctggctccattgggccccttccctcctgtgtcaccccctgggttttggcggtgcctcgttgtgaaccctagactccatggagctgggcaggccgggccccgcttagatttccaggctctagcctggcgccctgcagtcggcgtgctcttggcaaacgctccacgctgagagggcaggtgccattcaggcctggttggattctggagccgcgtctcaggacagctggggccatggaagtgtctagaagggaggggaaacctccctagtccgggctagcccagacctgagggtgacggggcccctcttctgagggtgacggggcccctcttctgagggcaaggagcccaagggccaggaggggcacggagaggccaggccgccacaggagcagcgcacggagccacgttgcacggtgtttctttaatggaaagacagccaccgacctcagaagcagcccctccttgcgctggaccagaaggataaggggagacctagccaccagtgggccagtgggggtgaggggcttctaggaaaaccggtgtctgggactctggcggttgatggtgtcatctgcgcgggatgctgggcctccacctcccaacctcctccgggacagtacaggtttgggggcaaggcctgagcagggcaggctggggagactgctgtccctggggttttgtgggcaggggctgggtgcaggccggacagacagaaagcagtcccagctcaaggcagaaggccagagggtgtggagtgaaagggacaggcgaagccaggttcggagagatggagggaacaggccaccaagctcagaagcgagaaaggtctgaggaagcacaagacacacacacacacacacacacacacacacacacacacacacacagaaagagagagagagagagagagagagagagaggaaggacggggaaagagagaacagaagggaggactggtcgaagggccagtggagcaggggtctgggagggacaggccatgaacttgcaagggggctgaggggagccgcagagtcggggagggttgaaaggctggaaatgcatgaggaggaggaacagaacatgtgtgtctggacaggtgcggcagccctggcagagcccactgtccccattcttatggaccgcctcctggctgctgacccagggactgttctcctaggactggagccttggacacttgggtttgggagtgaacgagaaaaaagcttcatggggtgcctctgggtggctgtggtgggagagcaggggcagctctgaggccaagggaacatgtgatgggggccgggccttgcgcccacctgcacccttgggagccagggagaggcggtgatggggcatcgagctggggtcagggacccgaggtggggggctgggttggacgcagctgggccctggcttagcttcctggctctgcctccccatcaggatgtctggctgtgttccccagagacccccactgaggccccgcggtggctgcagctgcctctactttttgtagttgccaaactggatggccaggcggtcagtgacgcagcggaaagtggccggctgcacctcccagtagggcacggggttgttgaagaggctgatgccgttgtagtaggcccgcttcaccccgaagcccatgggacagaagtcgttgacacccactttggtgatgttgttggagtgcagatagaccacctgaaggcagagaggccgggtcacggcaggcctccctccctccacgccaagcccgctgcctccaggaggcattttgctgttgcctctgcaccctacttcaagggccacaccagaggctccccgttgttgggaggagcaaaccaaggcatgggcgtgttatttgtgtgggtgtcagccaggattaaggcactggatgtgaccagggacaaggatgagggtctcaggtgggtcaggttgaggacatgtgggggcggggctggggtagaggtgtgtttggtggtgtgaggtggaggaaaggtggcctgagcctcgggggagcaccctcacactccatggggcatgagaggagaaagagcccttgggatgccctcctctttcttccagtcagcagaggagctcgccctctagcagcccctccaactctctggagccaccgtcttgctgtctctgggaggagcggaggtgggcaggcgaggcgcctgctgggttgggctgggagcccagtgctggtgaacatgacaatggccactagagggcgcactcggcccagcatgggcatggcctgcgcggtgctggctcgcagctggtgcggatgggggtgctccaaacacttgtggatggagcagggctgggcaagaccaagatcacccacctggttgcgggccaggccagggatggaagctcccgatagaatcccaggcaagaccctgctccccctcgtcagcctacttcctgccctgggcggtcactgtcttggcacagatctgtgcactcccacgcccacagtttctcgactccctggactctgccacatctttctggtgtccgacccacctggagaccctcgggtccaagagctaccaggctgccttgctcggtatccaccatggagcccctgctccctgcctcctcagcaccagctgggagcatcaggaccgctcccttgcagatgcccagagccggtcgggaaggagggccaggggactgagggactgcccggggacacacacgcctcccccagcccagccttagggaacctggctgtgcatgcccagctctcacctggaggagcttgaggtctgggagccctgagggcaccctggccaacttgttgttgtccaagtggagctcccggagggtgggcaggaagctcaggctcccgttctcgatcatcctgatctggttgtggcctaggcccagcctgtgagcgggagaatgacacggactcaaaggctggaggtaaggatggggggctgggcgcgaggggccacacagcactgagggactctggcatcacccttgggcggtgccctgctggcctcacctgtacagcttggagtagcgaagcaggtcctccagttcgatggcctggattttgttgtggtctaggtggagttcattcagggtctcagggaggtctgccaggagaagagggcacaggggagaatgcaggtgctgagggcaggggccctagctctgccccaggtggcgggaggggactgttgagcctttccctgagtagatcgggcccatccagagcccccaccctggccatctgtgctgttgggggtgaggcaggcaggcgtgcaggaagagtgggcttcctacctttggggatgccagtcagcttggcctctgagatgcgcaggtagttgagcttcaggccatcgaaggctccaggttcaaagccactgttctccagtgggttcccgcccatctctaggggagagacctcattagcccgggagcctggtggtccctgcacagccctgggtcctgtcacttccgggccagtgtggtgggccctgctacctgccggctgctcccgtctcctgaaagcagttctgctaatttaccgggctaattgcaaactcctagctgttcaggactgctagccccaggactgctagctccaggggcagcaagaggaaagggaggagtgccagagatgaagatggggctcccggaagccacccggcccctctggcccagtcttctctttagccgtggtgatcgcctgcatggaggatttgccaagaaatccatggattttcttttgaccgttctcaccatactctttcttgaactgagcctctaaaggtatcccttggtctcccttccccatgcctcgagacaaggctctggaatgttctgggaggccctcagctcaccgatgcagttcatgttccggagcccgctgaacactcccttgggcaccttgcggatgcggttgtcgtggatgcggagctccaccagggagctgggtaggttgggcgggatctccaccaggtggttcttggagatgtagagcttctgcagcttccgcagtgggctgaaggccttctcatggatcttggagatcttgttgttcaccaggacgagggcctgaagcagggtgggcggaggaggtgaaggcacagactccccaccccacccgcccctctctcctgccttcctgtgcctccccagcccactgggcctcgaggaggttcagtccatgcttgtgagcagagtgcagggcaggaggcagcacccaggcccggtcctgagccccagcagtgccaccactgccttgccgctccaagcctcagtttcctcacacgcacactggctacaatgaaatccgttctcctctgttgctgggaggagtggacgtgatgaaacgttttcagccacgaagggagccgaactgagcgatccggtcctgcagctgtggttgctcaaacccacatgagtgagccgcaaacccgggagctcccatcacggctggctccaggcttcaccctgaagccccacgagtccccgaacccctctcataccccacacgtccacgcacatgcacccacccggacccctgccctctgctgtaggcctgctggttcctcccagctccttacgtagaggtgctggagacccttgaagtcatccttgcggagctcggagatgtcgttgttctgcaggtccagcagcgtggtgtcaggggagatctctttgggcacagacttcagacctaggggccccacccccatcaccagcatgaacttgagacctaggggccccacccccaccaccagcatgaactcgagacctaggggccccaccaccatcaccagcatgaacttggagccatccagccgactagccccactggtagggaggaccggggacacacacacagggacactgacgggcacacggggatgccaccacaagtgggcacaaactgcacagctcacagccagacggctggacccctcctacacttacatcatgctcgccaccgtcccacaggaccagcatgtgtccccttcagaaggggctctcaggctgcacctgagcctccctgcatgccccgctccccatcactcagggacaaacccaggtcggagcactgaaccacccgcaggtggcagtggcagccgaaaggacacatggcgctgtaggtgggtgtgacagagtccgggtccaggacgcccgaggtgtcagcgcccgaagcttcctcatcgttcatcatgaatggcccatcgtccagggtgaagtcccagaagcctctctgctcaaagggcagggcctggctcagggccagcagagacacgaggcgccacaggggccacatggcggatggacctgggggaagaggcgaggggatcatcagcaccagcacccacctgtcttctccatgccaggggctggtgttccgcgtgtgtggtggcactgcgttcccatccctcaccagggacggccagaccctggagcgggaggcggagagggcggagtgtgggcagagggctccaggcaggaagggagtggatgctgctggcaaggagggtgccccctccactccactcccttcactgcttccactacccccctccccatcccggacaggacttggcttaatcaggcgatgaaatgtctcctcatcagcaagtctgcaggcccccacgcctctgagtctgccagaagcctgctttagggcgggggcgtccatgaggctgcgtggaggaggtggaggaggaatcctagccattggccctcaagggctttgaagaattcacttttggggacatcactgtggcctcctacccgggccgatccttcctttgagttctgggctcagggcagcgtggatgaagttagttgagtgcggcgactctgagttgcttcctccctccaccctgcccacgtttctcagagaccctctaaggccaaggtagggaggcagggcggagaaagagggggtatccttggaggccgtgggtaaagttggctgaggcagcactgagtggaggcccccgaggtggaggccgtggcgcccccaacactgcccctgggccttggcttcctcctctggaccacccgccccagccccccgcccacaccgccttggcccaaacagccctggagctcccagatctgctcgcacccttcctccctgcccacagcctcggcagcccagagaggccccccaggggagcaggctgccgccagggtggcagggcagggtcaggcttgcctgaggccccccaggccgaggcggcgagtgggagtggaggcgaagcagccctgcccgagcctgcccccagcacccacctctgcttgcctcctccctcctcatcagacacggtctcccgtccagaggcagccgggaatgtgccctacaggaagaggctggagccctgcctctctcaccacttcatccaccctgactctccagcaaaggcccaggtctcatcccagcctcaccttccccatctgttaagtgggaataaacatgcctgccctgcttgccacccagcctggggtggccctcggtgcatctggagatggggagcccagctgggcagcaggggcctctggcagacctgaagcagtcgcacgcccaggagaccctcacttagggccagtactagctggggaggggctgtctggggctccagcagagcgaggtgagccccctaagcccagctgctggttgcaggggtctaaggaggccgtggggaggtgggggctctgcccccaggccagcaccctatgagcagccccgccctgcccgatgcttccccagttgccctgggggctgggctggctgcccggggctgccgctttggagtccttgctaccagcgggccgggggcctgaggccacttcagggccaggttgggtctgagcacaagcccaggagagggttgggatggaggcctgtcctgtcgcccccatgcagctcctcgggtgctccagggagcatctgctggcacgcgtcccccctgcattggcatcccccctagaagccacccatgcgccctcccacacctgtggacagaggggcctgtggtgaggctgtggctatagcggctgccaggcctgtggagtggcctttccgcagccagccccggagccctcctgagcccacaggccctgggccacactgcaaagtgggagtcggagcccaaggcttagctcagcttccccctcatgtggagctggacttcatgctgacccctggggtcaccaggaggcccctgctggggcagcaccgagcctccctcattcttttgagccttgagatcccacagttgcagcccagggcctgccagcctcaggccggcccagcagaacctaggggaaccgcccggagggtcttggcccccaagtagggagaaggctcaacactcacctacctggatggtgtttcccttcctccagggcagggcagggcctccgatgcctgctgccgctgtaggaccctctcccagtgccagtggacacccgggggcagaaggaggaggaggaggaggagcagtgggagagaacaggaagggcagggtggaagcaggagagcaagatggagtgggggagggaggagactgccctgcccctccttgccgatgcccctgccaaagccgctacctcccagggagagtgagtcagggctgggacaccccgccagagccctggcaagctccagggtgggcagtccacctggacaggtagggttggggtggtccggctgggcctacgggaggctgtggggaggggctggggaaggccgaggggacagaggaccatctgaccatggccagcttggagccccccaggacccacgcattggcctggaggaggactctacagggactcctgccccggggcaaggggtctccccaggagctgggacttccctgcaggccctcctgttagggaatcgggccctccaccagggcagggggcacaggcacagggcaggccagtcacggcaagactggccatcggggtctcaggcgggttcccgggaccagctgtggggcaacgagggctctggaggcaggctgcctgatacagtaggatgtctggggggtctccaagagactgagaaaggggcaaggggaagaggttccctcagagcggggagggaggctgagggctggaaggcccatacacccgggccccgtgacagaggcagaaggacaaggtttggctggttttccatggctcatggctgtgcccaagcagtgggcaggctggaggggcgggggccgggcaggcttcccggcacatccctcatttcccctcaaagaactggcacaaaactgagacctctcccgaggaaggggcaggctccgtgtctgagcccacaggaggcagcaaggggcccatgaagtcagagggagccaggggagcctggggggaaggataggatcccctggagctggcctgatgagtatccccattttatggacacaaaagctaaggccgagagagaggctctgatttctcccaagtcactcagcctgacttggaactcagctttggcgcctccaggccccgcctgagctctcagctgtgctcctcagccacagggctccagccatgtctctgggcctgtgagagcctgaatgcccaagactgggggtggcagtttgggaggtcctggcagtataggctcagctgtcctcccaaagcctggcccctgccttctccccaccacctcacaccaagcccctccctcctgccagaacatgcacacacacacacgtacacacatacacacacaaacacacacacagatgcacacatacacgctcacatacacacacgtgcacacgcacacacctatacaaaacacatatgtacacacgtgcacacacacatgcacacacctatacaaaacacatatgtacacacatccacatgcatccacatacatgcacacatccacacatatacgtgcacacacctatacacacatgtacacacatatacatgcacacacctagacactcacacatgcatacccatgtatacacattcacatacacatatgatacacatatacacacatatatacacagatgcacacacactcatgcacacatctatacacatacatgcacatgtacatccacatgcgcacatgcatgcatgtatacacacatgcacacatgcacacatacacacatgcacacacatgcacacacacgcacacatacacatttatacacacgtacacacacacacacatgcatacatgcacacatacatacatacatacctgcacatatacacctgtatacacgcatacacatatgtacacacatacatgcacacatctatacacacatgcatacacacattcacatatacatatgtatacatatacacatacatacacatatatccacacatagataaggcaggcggggaccccagcccaggaagcaggaataccccatagtcagatcctgtgagacccacagcaagtccctccagtcctcaactctccaccaccacaactgaggcctctgggcctcagtttcccttcattggcctctctgggtgtgtcttcagggacttcagggagggtttcaagccccaccaaagtgtgccctgagctccctggataccatctctttagagcaaaggacaggggcggcaatggcataagccccaggtttggcgaccgcaggtgtgagtgagggaggaggctgggcttcctggagcctccgccaccaccccaatagggccctccttgtctgcccctctgaaagctagcgcagtcctctgcactggattgctcgaggtcacagccaaacaagatgcgttggcagcctctgagaacatggagggtccgtgccaggcattcaggccaggccaagggcggcgggagcagggcttgaggtctggcgggccctgggagctcgcctgcagatggtgtggctcacagctgccaagtggcagacgccggatgctgtctccgcagcctcagccctgggcgtctgcccccctgagcaacccgacctgaactctgacacatgtgccaccttccacgcagccctgcggggtccccgggactgtgtccttcctcccctcccctctggcctccaaagccttttgggcccagtttcaaccagcagcctggtgcttgtgcccccgctgacacccggcctgccccctgccactctcccaggccccagtccaccagtccctccccgccgatggctccagcctgtacttgggcatcaaccagagaggggatgtgtaccctccctggccttgccaaagcccggcgtgtgcgttcatctgtgggagtggctgcctgaggggctgggggctggagtggggaggggtggaccttgtgccacattccaagcccctgccgttgccggagcatgcccttcaggcagccacgcttgggcgtctgctccccttgcagccacgtgtggaggggctgggaaaccccggctcatctgctgctcaaatcctttccagaggttttctggcagggtggcgacaagggtggagttctcccttgatgcgcccagccacctcccacctctctgtgccagccctttgcagcctgtggcgcccatgtcaaggtccagcctgtccccacagtcggcggagtgcgggactcagcccttcccactgtgcgctcctggtcctctgcacacggactactgctgccccctcccactctccgaagagatccggggcctcctgctagagtctccaaggaaaagggaggatgctgtcacctctcagaggcagagcaggggactcatgtgatttctttacttagcatcctgccgtcccccgttgactataagaaggaagcaatgctcttagaacttgatgaaggggtaaactgaggctcaggaagttggccccaaactcttgcccaaggccacacggtgaggaaacagcagagctggggctgcacacactgtctgtctgtccgtctgtgtccttgcccccatgtctggacccaccctctcccaatgcacacagtgccacaggccccaaagctgacacgcttcacactctcggggctgtgcagggggctcccctggaagcatggcccttctgaggaccatcagtagctccctatggcccacagatccagaagcccctcctcagccccaacacagccagcagggcagcccccgcccagcctctcacctctgcctctgtctgcagggagtctcctggaaaagccatcgtctccccaggcgagcacttcagggccccagggaaggtgttcccggcctgccccccagagcctggggccctgcctccctccctccctggtacaggcccaccaaggccaggaggggaggggaaggtttcctgcagcccctccctgccgcaacccgctctctgccgggggctcaggctgggctgggattagcctccttcagccagccagggtggcccacagcctgcttagcttcaggctcctgggactgctgggctcccatgggtgtgtgtctctttgcatgagggcagcctccaagaaccatgggatggcagtcaaggccaagcagggactcagacttccagaggatagaagtcacactggcttcccagacttcccctgcctccagggacagggctgccttctaatcttctggccacccaggagtctgcccgccatgctccccttggcccatctgaacacctcagggaccaaacaggactgggatggccagcagaggcaagttcaagaggcccacagagtccgttgggcccctggtcctccagcttatctcaggccagtgtttaagtggagctcaggcttaagatgcagtggaccaggagagttccatgcaagaaggctggctagagccccaggcccctaagcctcagagatgagcctcatgggaatgggcagcaccttcaccaggcctgccagggagccgggacctgaccctgccccttgggctggctgggatcagagctgcgcaggtgggaagctgggagtgggagggttctgcagtcctcggaagagccaaggctggtggcccctccatagccaccccagaggctgctctgacctagagccatgacggggcaggggaagaaggcaaacagcgaaacagcgaagggggcagctgggatggttcccaggagtctagagtcccagaaggggcttctggctgtgggattcaagtggtggaggggatcttctggcctggaaggggacctggggaaggaggaatgaagcacaggccccacccctccagaggaggtggccccaggccttccccagggaaccctgggaagctggttctttctggaaggctgcagaagggcctggccatgggtcctggaggccacttaggctaggcgggcctcaggccaggaggactgagccatgcgccctccccacagcgcagcccctctgcacacaccccacagctggtccctctaagacttgcggaaagggctctgagtggccgagctgtggcccctgatctcccaacccagcatctgagcagaagaggacaggagctggggcactgatcgccccaggcccggtcggcagggtgggggccagggccggcaggatcccgggttgcgctgccttccgagggagccggtgcccacccagcggcctgcagcccaaggcagggtgccctgggaaagccaccgccacccccagcccctcggtgtgagcaagacccccagctggtgggtccccacccaccagtggggctcccaggcctgtcgggggctcggtggtgggcctggatgctaggggggcaacgtgcggcagggaccaagctctccggcccacagatgagtgggagggggtcgtggtgggcatgggaagacatttccgacaagcaggggtgttggggggtgagcaaggcaggggaggggccctggcaggtggggtgccagggaccccagggctggggctaggcctgtgggtggggcgtgtgctggggattctgtgggccgaggacatgtgactcccgggcaggctggagatgctggggggtggggggtggggggtgggcccgggaagcacaggagacggcaggtggggaggtcctcatcccacctctatacggggtggcaaggactcagaagcccttgctgaaggctctgagtgctaactgtcaagtgtgaactcattacaaacccctcctctggggacttggcgctgtcactggaagggacacgctatagctttgtttgagtgactctggaatgttgctaaagacaggaaactcattcttgccttggaaacaccccccttcctttcccagactccccatctatgcgttggtagggttaatgcccactgccgtacgggtccttggggcttgaaggtgggccagggaggccagggctgccacccacagctggccagcttgccatgggagccctctctgctccctggctcgcaacctgctcccaccgcccagccctggtggcttggaggcagccctgcatcttcctttcaatatacccacacgggcttgccctcaaaggctcaccatgctggcccacagtggccatacatgggcatgctccgcaccaagacatccatgctcatacaccagctctcctggggtgcggctggcaccggcggctgggtgtcaccaggaggtgctcacccgcacccctgggcgctggtccccgggagcctttctggcacgggggcaggggggctgagcatctccagcttgtctcagttccaattagttgctatagggcagagagctggcaggccagggaggggcgagggcccagaaacaggaccccctgaggatgggacctgagcagtctggcagccaggacagcaggagagaggcctgcccaccaagacagaccactggagactgatgtaccctgtgccctgcagatccctgggccccctgctctgctcagcaggcgctcaggcacccagccccgcccatggagcagtgagggggcgctcccctccgtgggccttccagggcactctctcgctccctctcctgggtcccttggcaggcccctctgggaccccaagccaggtccgccctggggagcatggcacagttgcctgattttctctccttcccctccacacccattctgagtcccagtccaagggggtcctggaaacagacagggctgagccacccaggcacccccagtcagggcccttgcagccagggctcccaggacccagacttctcacagaggatgtagaggcagagcattaacctgggggtgagcgagcgaggaacatctgggcagggtgcctggggtgtgcctgggaaactaagtctttcagcccatgccaaggactggcctcaggcagtgcagcggaggactgctcctgggtgctgagctcggtgggcgctgggcggtcctccccgatccgacccaacccgggccaggcgccaagccctggagcaaggaggcgcctgggcagagcgaggctgagggagtggagcatgcgcctgggacttgcaatgatgaaacagggccattggcaaagctggggtaccagtcacccagccacgctctagggtggtagccaagaagacggaccccgagcgggaggcagagagacaagaggtggatgaagcagagcaaggtcagaagggagagggagaggaaggggtgagggaaaggtgcctggagggcggcgagacgaggcagaagcctgacagggaccaagggggccgcagggtggcgatgaaggggcgtggatcagcagcctacagagagcaccggggaaatctgtggacaccctcgcggcactggggacagcaggaccagggcttgggacagcggaggcagcagagccaggggcatctctgggttgctgaggaggcagcttgaagccagccctacctggagaggggaggcgccaggcgcaggctgactagttggcgggctggggtggtgggccgtccgcacgtctatctgtccggtgtgtccggcggaccgaaagcagctactcactcctgggcagtttgtggagagagggagacagaggcggcgggcgggaggctaaaggctgggcaggcgggccgacggggaggggacagcggggagagggcggggagggaggaaaggagggagggggctggtggggcggagagggcgggcgagcaggagggggcaggcttcccggcccccctggcagcttcaaagggagcaattttcttgtagacggctggactagctgagcccccgccccctcgcccccaccacctccccccccctcccccgcctggggcagacagcaaaggaacggacacactcgcactcactcaaacaaggacccagagagtcaaactttccactgcccagatggggacactgaggtgctggctggcatctcgccaggcagaggaaagagagatggaagaaagacgagggggaggcggccttgggctgctaggcccatgagtggcccctggaatttggtcctgagcctgccaggaacctgcttgggcctaagcaaggaggtggtttctccaggatcagagaggtagctgttgtggatttctggaaggacttcatgtaggctcctggcgccctgtgccctcccttccactccagactttcttcccttaaaaagagggcccgatccggctggtggtggcaggacggggcagggggctccccagcttgcctgccctgaactgattcagagacgaaggatccagcgagtcagtcttcttgctcaatccctgcaggtcccctcggacatgagaaccactctgtgggtggccacttcctctgggctcagccctgtgctggtcacttacgggggctaaccgggttaccccaccaagactcagccgcttcctgagggcccaaatgagtccagttcctccagtggctagagcccaggtccttagtacgacactgcccccctgtcccgtagtgtccccttcttccctcagcaagagcagctcctgagacacaggggtaagagtttagatggagtgagaaacagatctgcaatagaactgggggccaagagtgcggaagaccaaaagagaaaattgcatattgagagaaaaagctcgaaggggcagagagggagagaggggtggctagagagaggcggcatccaatggagagaggacaacgtcgagggctgagggtcttcaacccctggcagtgccatcactcaaccggggggtggggtctgggaggtcccaggccagggaggatgctcccaggggagctctacctgggggcatggcagggcacagacccccttcctgttcaccagcggcagcccagggcctggctaggacctgggacgcatggcaccttgaccaaactgtggtacctgcctgcaagaagcttctagactgggccagggagaagagagacgtgggaaaccaggggccaggctggtaaccctggttctctcttgatttcatggttggaatgaggagattggagaccacatatgccctttccagacaaaggagatggcttgtctttcggcaggtttgtgtgttttaccttttgcccagcctcagcgtccgactcttggcagcctggtctcatctctgtcccaccctctttccctcccccactgccaactcattcgtggagaaatatgtcggtagagagcgggacaggcagcgaagcctgactagcagtctgggtggagagagaagcatttggaaacattccgctcagtgacagcagccagtcgcaaaaggccgcagagcctctggttccattcatttgaaatgtccacactaggctcatctgtggggacagaaagcggatttgtgggcagtgggtgctagaggggtggtacctaaaggtatgggttttctttttgaggtgatgaaaatgttctacaatcgactgagtgatggttgcacagttctgtgaatagaccatataaaagcccttgccttgtacgtgctcaatgcgcaaatcgtgtggtaagcacagccactctcagtaaagccgtttcagaaaaaaggagaaacccactcaaggcatgcctgctgcccgaggtgctggtacccagtaccttcctgcactgcttggggactgagaacccaggagctgtcactcagggcctcagcctccaggagtcccagtgggggtgaaacagctctgaataccgtgggggcgcagggccatgcacagtgccagaggctcgggagggctacctggaggaggtgacctggagcagaccagtagggaagagggaagttgccggtggaaggaagagcacacgtgcgggggggtgtggggagacacaggggagccaggcggcgctgcagtccggccctgcaccgacctcaccctcaggtctcagccaggcatgttcctggatgggggcttggaagtggcgatgaggcgacaccctgcttgggggagacacattatgcatgcaccttgcagctcttacctgaagttgggggctgcttctgggggcaatactcatataaatacggtccttgtacctggaaggtttttgtatctgtggtttgcagtctgcaataagccataactgcacgcccggcccggggcccaccgagtcactcggcctggctagggcccactgagtcactcggcctggccctctaatttgggggccactcccagaccagacaggcagtacctcagtcctagggcctcccccttctgctccccctcccactcccccctcctcaggcctgggctctctctgcagcgcagaaggtactttgatcccagctgaagtgctctaggaacagtgcttccttgctagcgagcagagctggcgggcgggcagccttctgcccttctggcctctcagggctgggaggaggcagggggaagcagggggaaggcaggcacggggggcgcaaggcaggaaggaagagcaggcatttcctgaggccctcagggatcctggggaggaggcggacacacagctgtcttagctccccaggaacccgcggcagacagggagcaggaggtgggggaagcagaacccggccccttccagcacggcctgtatgtgaccctgggatgccactgcacaggccccctaggccctagctgggatgcttcccccaaaaggctgtagagggccagaaggtcctgctggcaccagccttgccttgcatcccagcccgggagaccccttctcctgccggatggagccgagagctcagctctctccacctgacaaggagcccaaccccctcagctgcgtggggagggcagccctgggcagcctgctcaggcttccctgcagggaaagctgtcctgccctggcagttgcccctgcacagggccccaggccacactgtggtctccctgctctgagcctaactctggtctaggcctcatcaggcagctgccaccccagcctgcctgggacagcgcccaggacggctgctggaaggtagcaggtggggcggcagccatgggacggaaggatgggacaaggacatgtctgagggagggagagggccacggaagaagggggctgggaggaggggaggcagggcgcagggatctaagccagctgccatctccttggccagtgtggggaagaggacctggagtcagctgcagcctgtcccccacagctggcttgcagctgtttgtgccctgtcttcaaagctacagcagggaggcccaggagagaagcagggtgggggcgcccagagggcaggctgtgagctctctggtcccatttgggcatgaaatactggcgggtggtgtgagtcctagagggcagagcctaggagcctgggaggtggcctcttatgcaggggtcccctacagaggtgggctgcttgttccatgattctccagggtctggaaacaagaactgggccccgggctccctctgccctgctccccaagtgtgtccagtgggccctcttctctgtgggtggctgcttctcgaacccttctgcctggacacgaacctccccacccttccattctgatggtgtgaacagaagggcccatgcctgtcttggggatgggacggagagacagagggagagccgacagagctgggacagagagctgcagtgggcgaggcagacaggcagcactcccaccccctggaccatcagcaagaccctcaagaagcaaggaggtgacaagtgctatgtgcccgtacaagactggggggcagggagagcttctagaggaggaggcagtgccctgaggccgcctgtcattggggagtagctcttgcagagcctcagcttccagggcaaattcccatccagggacctgtcactcacacatcgaggttacctcttgagcaagagcggccccaagtttatggccttgagtgggcctcactccgagcctgtgggcttcgtccattcccagtgtcggcaccctcgggggcagacaccagtgggcaaccccatcaccactcaagggtctctggatgacctgcggcctcgaagcggcatgaagctcatgctcagcggggacctctgggttcagggggtggggcggttatggaggaggcttgtgccaacatgccctggggcagctgagctggtgctgagtgagcggagcctccactctctggaagcttcccagtgctggatggccgaggtgtggctggtgaaagctggcactctccatgccaggagctttttttgaccttcctctgaggacataatcacacagcatctctcccctccgggccaccagggctgtaatttcagggcctgcgtgggggctccggggaggcctggcctgcgtctagctatctttagagaggcatggtctggggcgtggccagaggatggaagatgggttgccttggaagccgaagtccgggagccagaggccaggggcaccctaggacccctgtggtcttccctcagggaggccagaggccagagcccaggagcagcaccaggaggctctggtgggagtgggaaggggctgggccctgtcccgagccctgacttcagctcggagcaatctttggcccagatgctcagaagatggggtgggatagcacctggcctgagggccagacagcttagcatctcccagactgtccccgtgtggccatggtggcagctattatgggggtagggggtggagggtggcacagtaggcgagatgcttgtgaacgggggtgttaggctggagggagggctcagaacagaatgtggcgaaggcgaggggtgggcccgtggggggccagtgaggggcagttggagaagaatttggaagctgatgggcagttttctgggactgcagctggcagaggcggagcagaggtgcaaggtcccacccaggtctcaggccggagacacaggcccagccccagggagggcacggctccttgcccccattctccacccttctgaattgtgagctgtccccactgtccttactctcagtcccaccccatcacctcagcatccccatccccatctgaggactgatgagtgcctcccttctgaccctagtcacacctatcctgttgccatcactattgcaattgtcactgcaatgtcccctcagatgcccagcattttggggtcaccgattggctgcacccactgctgtaccctcagatggagccagcagccaccccgaagaggaggagcacagtaatcacagagaaggtgggagtgagtgggtgtcggagcgtggcccgtgctgaaggaggggcaggtgcagggccacggctgggctgcccttgctctcgggctggggctctgtctagagattccctcgtggtgccagctagactctgaccagccctcccacagccccaagaagtgaagtccccagccctgagctcctggccctctggggaatcccctgggctggaaacagcacccttgtcccagtcatgagggggaaataaaggcccagtccctttgccccatctcggagtgcaggttggctgaggcctggccgggcctgtggggtcggctgcagcccagcttctcccttggccaggtgacgaccccaagagcccgcaggtacatttcccaagtgcgagtcccctgcctccccagttgggaaggtcacaggaggattagcccccgccgaggctctgagaagtggaattaaccacctgtgggtggcctgcctggcccctgccctcctgcagctgaggggcccctccccttctcctccccacctgcctcatctgtcgggcagtggtaagaagtgggcaggagatgtcggggactcacccagcctgcacttcctgtgcctcccgggcctgacctctgggactgcgagaaggtgggggctgcagggtgacctgagcaagaggcgcagggaccggggcggccaggcagggaggaggggtcgtgagagctgggagagtggggccagcgcctcgtgggctgctgacctctgacccagcccaaacaggaagtgccatatctgaggggccagctggaggagaaggaatgccgggacgagtccaaagcaaacagcccacagcttcccaggcctctcccgcccccgccacagtctggcgctttctccactgagaactcaggggtgggggcaggggtagggggaatcggccatggaatgggagcaaggcgagactcagttcccaggccccggtcctaggcagagctgatggcggggcgaggtccttgcagcggacaccctgtgcccttcctcctctgctccacccacatccagcagcccggaggcagaggggaaggagaggggcggccccgccagggtagagaaaggccggggaatgggaaggccgtgcccagatcgagatgggggtgctgaggtgatggggtgggatagcgagggccagaggggcatgctggaggctcacaagttagagggacagaggacagggacggagccatgcgctccttggggctgggctgtgtctctgctgggccctctcctgcggcatccttcatgcctgtcacctggctgtctctgtgagccccatcccagggcagtggctgtcgtgttccctgcggttgtgaccctttgtccctatcccttcctggcacagggcctggtggcctagagagctgtggaggctgtcccaggaaacccatccggttcccaggggccccctcactcaggcaggccaacggggcaatggcctcagtggccttcgagggctccgcagacccagtgtctccaccagcatatctggccagtctgtcttcagggctcggcagggctgagttgtcacttcccagggactcctggcacatggggaggtcaacatggagggccggcctcgctcaggcagacagtcagaaactctggccaggggtggtccttgcccagtgctcagggcggggcttggctttgcacagaccacgtgctcactccccacccttccctggcaccaggtcagataggggcacagcctggtctcacagcaagccagccatacatctctgggcaagttactcatctgtgagctgagggtggggccctggggacctctcttgcaggtgggtgtgcatgttgggggctgggatgagggttctggggccaggaatgggggggaggtgtcaagggagaggcaaaggggcttcccgagaggtgccactgtgcggtggtcaccagcccctgccccaggcctcagtgcaggtgtgggtggctctaggaccaatggcaggtgccctgaacctccacaccctcctgctctgccagccaagcccacctctttgggtccaggcccaggatagggatgagacggatcaggtgcagatgctgccccaagcaagggtggggagcctggcctcttgatggcttgggaccgagcaaggacttcaggaccctggtgaggcagggtgggggtggggaggctctcagagaagctgtgggacccaagccctctgaatctctttgctgacagtctcaggtgcagcccaggaaccgcacggacatgggagagccaggacatgcagcgtagctcctggagggagggaggctggctggtgagcctgcccaagctgcatttattatgttcaagtacaaaccagtgccacctttcgcccctgggccatttgctaagtgaagcggcctcaccagtcaatgggaagtgggtgcactggaagcagtggggtcttctagacctttctcccagtggtgcaaaggccaagcacacctcagcctgcccctccaccccctcgagaagcagagtgtgtgctggaggaaggcggcaggcaggactaggagccctcctccccccgccgctggggctggaggaccacgctgtgataggctcgggtgcaggagaaggcagtgggcgggatgcggcgccggtcaatgaggttgttctccaggtgtgtggaggtaaggttggagtcctgagccacgcgcatgtcacagatggaattcaagggcacttgtctgcaagggaggggtggggcagagcaggggagagaagaccccggaaagacggggtaggcatcattcaagaagagacagagacccctgccctgagagaagcagtaagaccgagccacagaatcggaactgtggaggagtgatggcgggcttcagagaccactgcggcctcctggccccctcccaactcgaggctcagtgccaggcctccagccccagcccttgtcgctccaggctggagccctgccagcatccggccactgcctgcccttggctttccaggcctgccagccactgggcacagcctccatcatggcaaccaagatgggtggatggctggattgggggaggatggatgagccccgactcctgccctcggcctctgcggcctgtgggtaaggagcccaaaggccagcctgtcctagcccagccagaaggcagggcctcctggcctcagggtacctcttcctctgtgtgctggcagggtgcgggggtggagacggccacaggtgtggggtcgaggaggggggccctacctgatcctgttgtggctcaggcccagcacctgcagtcccttgaggcccaggaggccgcgtgggatggcctgcacctggttatgatccaggagcagctccgccagcgaggcgcgcaggcccaggaaggacacgctgtggatgccgtcagcctgcagcctgttgtgggacaggtgcaggaactctaggcctggcttcatgtgcgcgaacgcgtagccagggatgcgctcgatgtggtcgtggtgcagcgtcaggcgcctcaggccccgcggcaggaagcggggcacgtgcaccagccggttgtaggacaggtcaagggtctccagcttcctgtggggcggggcacacaggggcagagggagctgacggttggcaactcctagaggggagttccaggggctgcagccccacactcccaagacgagcgtggggattcactccgagatggcagccgcaacccgaactctcaacagctgggactctggcaactcctgtgtgagtcaggccaggccctgtgtgggtttatgtcctcctctgtcccccaaggcttagggattagaggatctgggtgggggccttccttgctccctgcagggctagcgatacctgctgtcattgtggagactgaggaactgtcctcccactcacttccttccctccaggtgttgcctcagggtctcctgtctcctaatcctgacacctgacagagctcagagggtgacgcctaaaatctaggggaaaagtggggcaggggagctctctgcccctgccggtcctcggcctcgaagccctctcctctgtcccttccactctcctgccctcatcctgcctctcccagtcttatcctcagatgtgtggaagctagatgtgtggggagaaaaagatcaggctccatgagggttagggctgggggaccctgggaggtcacccagccctcgctgtccgatagtggagttcaggctgccaccttcagctgggagcccccggtcgctccatggtggacacctgactccttgaggccctgaccccagcagcaggaagccctggtccctgtggccatgcaggtgtgcaagggcagagggtggtgaggcttctggaatgggtaagaacatggagagagggagcagggaaggcttctcttggcaacaccctcagcccccgtggctagggtcagccttttgggctgctcctgtgcctctcggtcccctccttttccaccagcccgaaaagagatgggtggcgccagagtccaggagaggccgcggctgaggcagctggggcttgactggccgccagccccctgcccaggcctcgtggcgggagtggaatagcggccgggcagcccctcccaggctgctgtctgctttcctttgcccccttggcaagtgggggagaggaaagaggaataattaaacccaaacgtcctggtaactttttcctggaacgcaaggatgcagggcgggaggctctggtccctggaatggcgggtcagactgtctgtcgacccccgcctccctccccactgcggccccaccctgccttggtggtcatcaggccctcctcagcctcccgcctggcacccagcctcccccagccctccccgctgttcccaggaccgtgtcctgactccctagcccgactcctacagccctacagcatctggttgccgtgagtggcctgtgtgccagcatctctacctagctgtcccaaccagatccagggaattgcccttgacttttcttggaatgaggtgaagagtggcccccagaacctatgtccaccagaacctgtgaacgtggccttatttgcagatgtaaggattgcaggggaggatgtcgagctgagctcatctgggttccccggctgggccccgctcccatgacaggtgtgcttttgagggacagaagagagaagacgagacagagggagacacgcaggggagacggccacgtgcagccacaagcccaggaacacctggagccccctgaagctgggagaggcaggaaggatcccatcctaggcctccggagggagcacggccccctaacatctagattgcagacttctggcgtctgcaactgagagaggttatttctgttgtttgaagccacccagcttgtggcactcagtgatggcagccccaggacatgcatgcacttctcttccccactttcctgtgcccccagcccttccgcgctgcttcctgcccctgtcacctcctaactgcacccatcgtcgggccagctctccccaccactgctgccctccatccaggcccgtggcacctcccaggtgagcttcctgggggccggcagggcaggcctaggcacgggagggcaaaggggattctgctgggtgggagggacagagggaaggccttgcaagcttgcaagcaatatcttggaagagtctgtggtgactgagggcccaggctaacctaagcagggagggaggtgaccccagtgacccaccgaagaccaggcccaaggaacaagtcctcccctggagccccctgcctcctggccctctctggggctccgtggctcagcattgccctctccgccttccccacctgcctctcggggctgctctgggccatccttgctctctgcctccgaatgcccattggggcgaagctctgggactgccactcacgggagatgaatccaggctcggggtgccagccagtgctcctgaagccagttgtggctgagcaccagcacgctgaggctgtggatgtggctcagtgcgccctccgccacctcctcgatgaggttggtgcccaggtgcagctcctagggtcggggtcaggggttggggtgaggggcccacctgccagttgttggccacctggtcaggctccaactctggctgtgcccattctctgccggcactgcctccttccacccagccatgtctgtgcaactcaggtgccagtctctgccctgagcagtcaggcccatggcaggggtggattttcaggggactgtatggtccagagagagggtatgggccttactcagagaacccagagggtgcagagccatccaggaggtcccactgtgggcttctggaaggttaggtcaagctgaggagaggcctgaagcctcgtgagtttcagcgcacagatccccctatgggctgctccacgccccctcagcagaagcagaggcagggttgtttgatggtaacaatgttgcctccccatcctgggggctccagctcaactgcagggaggacggcaggccgcgtgggatggcccgcagccggttccggtccagcctcagatagagcaggctgcagaggggctggaaggccagggggagatgtccctgtcacgcagctggttcccttccacctccagcgtcaacagctggctgagccctgcaggcgggcagaggggtgcggtgagccattgcagagctgctcgcagtagctctagaacccctgcctgcccctagaggccagggccccttacccaggctggcagtctcctctgcgttccagccaggctgccctgggcactctcccgagtgtgcctcctagagggcagacccaccccttgccagcccctgtcctgggggtggggcacctgcccaggcctgccccctcggtccctgcccccggaactcgcccgcaccacggaagctgctgccttgcaagccctgcaggaggttgtcgttgagtttgagctcctgcagggaggcaggtagggccgggactgtggtcagcgagttcccaaccaggttcagccgcttcagccgcatcagattctgggaggtcatggggaataggtgggctggggttgggggcctgctggtcggggcacaggccttcctgggcatggctttgggcccatcctgaccaagggcactctgttggtggcatcatggcttcctagttcccactgaatccaggcctgtctgggaaggtttctgtttgctcctatacagggcctgcaagcctgtgctgctccccctactcccagcgatggaacacgtcacaccaaattgtggaagcccaccatgctggctgctctctgcagtgcctcctccaggccttaccccctaagcagctccaccctgcagtgagtggatgcctcaggtcacctgggacctgccagccccagccccagccccggcccccgagaagaggtgaatgggccacagcataccttgaaggcatgggggtgcaggcctcggggatccagcttgttcttgctgagatccagccactccaggttgggcagccccaggaacgtgtgggctgggatcttggcaatttcattctctgtgcgcacatggggcagccatattctctgccccctgcccgctgccactctgtacctcccacaccagacagggctgctcaggggagccagggtgggagcccaggtctcagccttctcacccctgctgcaggggtgggtgtggggcgaggaggccacccacctgccaggtagagtgtggtcagaccagggtgggtcagggcagggacatgcttcatcttgacattgccacaggcgatgactgcctgggccaggaggcacgaggccggcagagagggcatggcctgctgggtggtgcccaggtctgcgtgcctgtgcctgtgcccatgtgtgcttcctggtcttttccacccatggcctggggtcttggaggtgctgccgccgccaccctggcctcggctgcggtccttctgtgggcgccggatcctcagcccaggttgatgggaggtccctggaggaagagagacagcccctgctgggtcacaagcaacaggggccctactgaggaacaggggcttgcccgaggctcccagggcctgccagtgactcagccagcctgggttggagcgacaggttactgggacccctccccttggcaccaagggcaaaggcccaaatgggggctctgaggctggggaggggacgtgactttggagggcttccctcccaccccacacacgagggcacttggcttggaaacaccgggaacggggcagtgcctgggtggccaaactcatgcgtggtcctgtcagccccagcaggccccaggccccacctgaaggccgcctgtcctggccagttctcacctttggggggcctcctgggtttcaggccccttcccttgtcttcccggcctcctgtcctctggccctggtcctcctcggtgactgctgccccctcttgagcttgagggtccctgccggcctgccagggcctcagcttcaaggcctcgggcttccctgccccagccctcatggcagctgtggcctggggctgagcccactcagcgaccaggcccttgttgtgaccctgctcctgctccaaggtcactgggggtgactccttcctcagggccagccctggcctgggaagcgctttccagccagtggagggggactgggtgggggttccttgagctccctgcttcggggtgggctgatcccgcaactggtccagcttcccagcctcaggcttgtctgggtggccgatgccagggatgggctgcagctgacctgcggaaggagccagtgtgggctgggggccttgcctcctttccccaaggggctgtcagctgctagaaagcccatcgcccttcctctttacccaggcctccccccgccccgcctttcccttacctcctgaggagcactggcgagagaacagagtgtccccaccgtcagcagcaggccaccagcccctggggccagtaacccagagtacctctcagaacttacacagctcctcactgctggggaggggggtgggtggcgctctaggcccattagggctaaggggctgggcctataggttaggcccaggggttggaccggtggttgggcccagggagcttcagcagccctgggtagaaagccttgggctgctcaagggaccttgggtcccacctcccctcacttccccagtgtgtcccaagggtggggggtagggcgtttccccagcatcccctttgccccatacccattagtgagcaaggacttcacacgtgcttcctagggacagcttctggggagatgaaggggtcgctgcgacctggcacaatttgcttttagaagtgaaagccccagtgtctgctacagggggtttgttggggattaggcaagcccaggggccacctcaaggggtctgtgagccactttggaggaatgttgataaccccaatgcctcctgtcctctatggagcagctcctccttaaccagggccaaccatggggggcaccgctctgtctgcaggggtgaggggcagacccacccacctggcccctcccgccctacccccaagcctggggcagggccaccaagtgtggctacaaccactggcctataagacaaaggccacactcatagcccatgtcctcgggcccctcaagcccctctctgccagcaaccccacttcacccccaagccctatactcccagccacctgagattcttcctgtctcaggaggcactggggcagccagagcaactcctccccagcacaccccagcccgctctcagcctcactgtagcgcccgctcctaggaaggcctcttccctccctcgcccctagagtctgcgcacacccctcgccctccagggagggctctctcagggccatgggccctttgcagccctgcctgagtacccaaagtgggcctgaggtggacagcctgcggcagtcttcttcctgctggtgccagctactcaccgtcgggggcccctggtgggctgggcagcagctgcagggtagccaagcccatgggggttggtggggcccctcctgagcagctccccgcccacagtgccaggatggggagcagcacactcctcttggctgccatggagggaaggagagctgggagaggcacggtggtggccacggcaggacgatggcggacggcacaagttggtcttgctccctgagctcctggccctggctgcggcacttggagtcttccctgcccaccccagcccttccctgggaaggccccccttctgtcgagcaaacgcctcccccgaccttgcccccaactccccacaacgtgcactgctcccacctgaagagaaagacagattgccctttcctcagaccggacggtcctgcccttttgctgtgaggcccgcattgattctccgctggctctggcccagtggcctccatgaatggggcttctgtctcacacgtggcaggcctgagaggcccaccacagagcgggtcggccaccgcaggctgctgggccctgcatccatggctgcgaaaggagagggggtgggtgccaaggccgtgggcttctgccgtgggcagcactgtggaggcctccgggttccagaggaaatagaatctgtgggcacagtgcaggcggcgagggtatgcctcccgtgcctgagaccccagtgctgcttgggcatgggtgtgcctcgggctgggctggctcctggttcctctgcttgccctccaggtctctaccttctcctctgtaaaatggggtagggggcagagttgacgttctgtggctgtcccgaccccctacataggagcatgggtgttccaggcactgcctgggtgaagccatgtcacaggtcccccccagacttcttggccaacagtctgggatctctgatgtgcctaggctgcacgcatccttttggtcagaggggcacctgtgggtcaggatgacatgaggtggaaaataggctgggctcgatgaggggactgctgggtggggccagaggggcgtgtggtggagtgaggggcaaataagggggtgtctggctccagttcctagagcccgccaccctcagagggctgccggaagtccctgctccaactggggtgtccctgcagccccaaccccgcgttctgctgtgggagccagggtttgtgggagcaggcaggcgggggctggcagagaggactgatctcaccgctggctcggctcttcagggccagtattgaggaagcttttcctacagccctgtccagcgttgacttaggtttggaagcgatcttaagaaatgagttaattgtgggcaaggcttgggtggaggggagaagggaagcagtggaggaggggcaggggccggcaagggccatcaggcaggagtctccatcctggggcaatgaggcaatgtgtgagatccagaggggtgcagggctggtcaaggtggggaggaggcctggcaactgggtcttcactgggctccttgaggagctgccgctccagctaacagtcccgtaggagccacatggggtcctctgctatatccagggtaccctcgccatccagggctctggtttctgacctgaatttggaccctgccacgtacagaccagaaacagggaccatctagggagtcagcaaatgcctctggagtcagggatgaggccaccatctccttgtgcgtcctgtgggtgacacaggatggctgtgggccagtgtcctgcctgggggcagctgccgaagctgggacagggtagcactggggcacggcagacttgaagtatgctgccaagactaagtgaagcttgccccaggatcctgcaagacagagcacagtcgaccccccattttacagagaaggaacagagaaggagtggggctcacccaagtctcgataccagaggccagtcctcctgcctcctggtccaggcatcgcctgagaaacggggtaggtccctgcctgagctgagcctagcacctggggtcgggagactggacggtgatgggaaccccggctccgcccctccccctgcctggggatggattctggaatcctggccccctacccatttcccctgtttgcgccgctccccaggcgctgactaaacatcctgccatctggttcccattagctgggctgggggtgggggaagcctgctcccaggtttctctggcacagccagcctggaggagggagggactccgctcctacccacctaggcaggaaggggtgaggcctggggtgctctcagttcccagctcccatggaggcctggcctcgctgcccttcccctggtcgggagcctggtggctgacctgggtgggcccctggggagtggtactcctgctgcccactctgtccagtcccagggcacccggccattgtggggaccttgaaggaacccccatggagcagagccagccttcaggggctcagcagagccagaggctcccggcaagtttctgccttgccctcccccccgcccaagagctcactgacggacttgtgctgagacaggcaggccccaagccaacagtaatcccgagcccggtgtctggagcagagggtgggagggctgttgggattttccaggaaccagggatgcagcccgagggttgctggaaagagctttgggctcccagttctgccatggacggactggccatgtgacatcaggaacaagcttccctccctcctcagtgccccagtcttctcatttcagtatggtggaaacaggctccttagaaagttctagaatctgagagccagaaggcgcctagagaagctggattacatgatcaaggtcgcttctagttgtacaatcccaggattctaaggtcaaggaagggactcctgtcccttgtcctcctcccccttcccttccatgtagcccacgcttcacacactcatgcacacacataccctctacaagctgggactcagattggtagcctggaggatgccaaagcaatgctgtttgtccctcaaggctgtcatcaacgaggactggacagtggattctttgctcactgacaggggatcaggtgaggaccgtgagaaagtgacatttgggcagaggcatgagtgaagaggccatggccatgcaaaaagccacagaaagagccctccgaaaaagagggatggccagtgcagaggccccaggtgagaaagggttgggcccaatttgagcattggcaatgacagcaatgtggtggagcaggctgagtgagccgtgggaaggtgtctgtggcggtgggctggcttgcctttgtccttgaaagaatcagggagccaccttggactgctaagcagaggagtcacaggatccggcccccctcaggctgtggggtggagcacgagcagatgtactgggggcataagggtaggaggtgggagccaccgtgtggcagctgagcccgccaggggccaggtgatagtggctggccaagggtggaggcggggttgcgaggaggagcgggtggggtcaggagcatttgggcctcagggtcaaggtctgggggctgttcctgctctcctgctctcctgctctctgcaggagcacctactacgtgcctgtccttttcccagggcccagggcagccagagacacagccttggggtgacccccagagaaaaggaacaggcccattcttgagctttccacatgttgtctgagtgaaaacgacagcagtgtgtggcacatgggtggcattctctggggacatgcgcctgcagctatcttatatgtcagtaacaatatggggcctttcccccttaaagcttggagaagaaaaaagccccattttccatgccctcttcctgttgcccgcaactcttccctagaggaaacccatcttattttaatgctactgaaacctcagaggatctggtcccaattaaatgacttttcttgcagacgctttggtgagcactaaatgcttgagacctggtgatcctgagcgagagagcctgctgcggggtgggggtggagaagaaaaaggagggaaggggaacacaggaccccaaatgggacaagggtggctgcggatggggtggagggtgccagtggagggggactgcagagggtggcacgcagcagggaccagcccatagggagcagggccgtggtcgggatgggggcagaataggggccagtttcccaccctctttgcccgtgtgaaattcgagttcattcccgcccatagcgtggcttcgctggactccgtgtgaaagcggccccgccccatcccctccggtgggcttcgaggacctcggcagggaacggaggttgggcagaagctggagctcaggcccggccggggagctcgggcaaagcaagaaggcgaggcgggcgccccctcccccggccggccctccgagcgggcacgttcgtgttcccgtcctggcgccctcgcttcccgctccagacgcatgtgactcagccccgccggccttgccaagccgtctagacccgagcgtctccccgcggagggggcgatcccgcccgccgccgtttcctttgccgccgcctgcgcggctgcgccccgcgcacgtgcagcagcgctcgcccccgcccgccacctcccgcgagccgcgtgcacgcgcagccactcgcccatcccgcgccagcgcccgcgcccccgcccccgcccccgcccccgcccccgcctctcccgttgcgtccactgcaaacaggcagttcgagggcagaagcgggaaacccaaaggtccccagggccccagaccatccctcccatttttggggcccggggcaggaggacaaagatggaccgctgagccactgcctccctgccagccagactctgtccacaccccctacaactgcctctggcctcagagcaagggtcgccctaggtcgcaggccctgccctcttgcaggagcctgtggcctgggggacagggcggggtaggtgatggtagcacctccaggcccactggaggcgatggtgatggcgatggtggtaccatgctgactgcgctgcggaatgtgctcttgcaggagctggtggcctgggggcaggatggggcaggtgagggcccctcaactgcaggaggtgagggtggggccctaaagcaggaggcccagcatagggactagaagtgacaggaagaggaagccaaggtcccaaggcagcctctccattctcatatgccagtagactccaaagatgaacacggaggcctaggaggagaacgttgtagagttgagtcttcaggcagctcccaggttgacagtgtggtccctccagagttagggccacaggccgcagggctcccccaagcttacagccacttccttgtctcatttgcaaggcccccacccctgctttcgtgttctccatcccttcccccatctgcaaggatagggctgggtttcgggtgggctcctggctggtgcagatggcgtgggctgcccgcaagacctgggtactgagcctgcatgccaggatgcagggtggatgggtgaccaacagctcagcctggcagcttagcagcagagaggtcccaggaagacagggaggagatgaggagaaggaagagggagaggaggacaggacggggagggaggggaggggaggcagaggcagccccctggctttgccttgcctgcggagagcctcacactcagaccgtcctgagcctgacctcattactctgtcacatttctccctcaaacccaatgccagggctcaccacttgcttctcgcatgggtgtgatcagcttctcatcttagacctgaactctccccaaaacacacacacgcacacacacgcacacacttgccttgtcttcaacagcttgcatttggtactctccacccttactgaggaactttagtggccaggggtggggggtgatggaggacacttcagtccctcaaaggctcctccccaggttccctggttcagggccgggagtcgaagtggccccgtggagcaaggccttctagggctttagctctgacagcattctagggcctaggcgcccccaggtggggtggctccccctcaggtctaactccagcccctgccagaagcagacccgcctctgcagagaggaaagcccttggacttcagcttcctttgattcgcggtgtctttgggggattggggggtccctggttgattcccgctgcaccgtggggtctgcccttaaggtcatatgaagagcagggcccggatgctctgaggactttttcaataccctccacaggtcagggaggctgcccacttggtgagctcaactgtttggccatatatctctgggcccaccacacaaactgagaggtctcgaatgccaccagcacccgccagcccatctctggcacagcggggccagtgccgtgaaccagtctcattttccaacgtgttttccaagcactgacacggctgaggccctgctgggacgcatggccaactttcctccatgaccaggaccccccagcttccccgccacatccacagcttccccccaacatccctcctccaggtcaatgggtccttcagccacatttttggctcctgacccacccaggcctccctcagagaacctggggtctctgggttggaatgtcccttagagatgtgccccctccctcccccatggtaggactcaaccctccacatccccgcccacccacctccctgggcttgtagaccttctaggaccgggagctcccttcctctcctggcagccagctggtgttcagacagtgatttctgggaggagtgctttcttggactgagcttgagtccacatttccagaagcttctacctctgggccccttctttcccccttcctgagaggcccagcagcctctctgttccctccccagcctccagcttttccggaggaagatgcctgggaggtgctatgattctgggggcgggtggtgggtggcaggtggtgggtggtgggtggtgggtggtggggtggcgtgggcagggaagctgcagcctgctgctgggtcttcagcgaccatctccaggggctgagggctggccaacaggttctccatgagggggatggcctccataacctctcaagatgatcttcgcctctcaaggccctgccagttcctcagggtcccatagactgaactgctgaggttggggaggcctgttgagcacactggctccgtggagctgggtggaggagggagattttcttccagagtacacaggagctggtttcttcccggtcctcaggagcagagaatatggggagggttgggggaggctgccacactgccgtggtttcttccgccaaattccccagtcctaggaaagatccacagaaaaacccacaagaatttgaatgtctgagctggggctgtgattgagatgaaattttctaaaaagaaagaaagaaaaacaaaaacaaaaaagagggaaaaaaacgcttaaaaaaaaatcccaaagcctttgacagccctcagctaccagaagggcctgaggcagcagccacgtggaagggtagagagcaaccttgaggcacttcgctgggcctgtgtcggggcctcccaggctgaggtcccttcctgtgacccccggactcctgcccgctccctcctcccaggacggagtgaagtcccctcctgtcacttggatgactgcagttgcctcccagcaggtccctgggtctccctgactatagacttgccccctgatcccaccctccaggagatggcagggtagggcacagaggagggcacagtggcagctgcctgctgctgtctcctggctactgggcacaagccaccctccaactccttcctgccttgcccaatcagcaggtccctgggtaaggggcattcagtgaactgggggctttgcaggtctgggggaggagcgactgacatatttcattgcagacgcattgagtttgagggtcctgagggatgtagaaaaatttgttaagtagacaggataggaaggagccacaggtagccccaggagccgtgaggggagcagggcccagcatgtattacaatagtgagcatttacgtggttcttcgcatgcgccgggcactgttctagggattccacaggaattattaccgcctgccatcctcattagcaacccagtgggtaaggtgctctcattagctccattaggtgagggcaaagaggcacagagaggttaggtaactggttcaaaggcacacagctggtgagtgacaagaaatttccttctaactacagcgtgagcatggtgaagagaagacggagccccgcgctgggagaggaacgcttcagtccgagttccattctgcacccaaggctccccttggtcctcctgggaaccagggtgccccttagtggtggtggcccaggagaacccgaccaaggcaggagcgccccctcctggaagagcctcgcttcaacgcatcatcattcccggccggcagcaggggcgacgccagcaaggcctgcgactcagagccagcttggcccgttcgccccgccccttcccggtgtccgccccgcccctttcccggtgtccgccccgcctccttcccggtgtccgccccgcccccttccctgtgtccgccccgcccccttccctgtgtccgccctgcccgcttcactgtggtcctgcctctgggtggtgccggggcggggggtgggagcccggggcccgcgcaggcggagatgtcgcccaatgggaagggtcggtcgggaagggggtgggcgcaggcgggtgggcgggaagaacgctggaggttgattggcggtcttgccggccagtgaagccagggcatgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggtgctgttggcccagaaagccactccagggcgggggaccggggagggccccgcccgaggcccgggagggcttgctgcggaagtccgcggcgccacgcggccaccgtcgccggttccggctgcgccctgttcccttgcagcagggggtgcttgtggatcattcatctttgccctttggtgtgccccaggccttcgttcttgctgtctccacggcccgtgcctggtagttggggccagcaccgcctgtggaactgcagtacccgcgctgggcgctcggagcaagtgcagacacagaggacccaggcctggccttagggatcttgcggggtctggggggacagatgggcagagcctcgtgccactctgtcaagtcagcgagactagggcttggtgtcagttggtgtcagatgccaggggtgatagcctccagaagccctctacagccccacaggacagagccctcactgcagcagtgaggaaagctggcccacgaggttagggagctgtcccaggtcccctcggcccgctcgctcctccccccagacactcccccatcctgtccgcgactggctcagtggtccctctccctttccctctcccctttccctcagtcccgaaacctaggactctctcttaagtcttagtctcaggcgttgctcctaggtcctgctgccacaagagcccagagtgggagtacttgaaagaggtggggtctgcatgccgcgggagatgtggggttaagaatggggggacttgaactcttggcaagatggcaggacgcgggtaaaggaaagggtcctgggagcttgcagatgtacactgaggactgggcgcggcggcccacgcctgtaatcccaccactttgggaggctgaggtgggcagatacctgaggtcaggagtttgacaccagcctggccaacatggtgaaactccgtctctattaaaaatacaaaaattgtccgggcgtggtggcgcatgcctgtaatcccccagctaccctgggagctgaggcaggagaattgctggaacccaggaggtggaggctgcagtgagccgagatcatgccactgcactccatccaggctgggcgacagagtgagactccgtctcaaaaataaataaataaataaaatgaaatgatgtacactgggactttcagtgaatgttgctttccttttccttgcttaggacctaaactgccccttcctcgagggtctgtatatcacagagccaaagacaattcaggaactgctgtgcagcccctcagagtaccgcttggagatcctagagtggatgtgtacccggtaatgcatcagtttcttcctcttcccacctggggtgtgcatgggcgccagccagccccacctggggaagatggggtttgtggttactgtgagtagctgtcttcccagagggctccaccccctagcctggaccctcgtgagaacagctgtgtaggtaaggagtactggtgacaggcatgatcaaacttggggcaaagtggcccctggcggtgctgggctagtccagccacccctttgctgcagtgctgaacttgccctcagcgtttgccttgccttatgagtttggaggttcaggactggcaggcacctgagaaatgctccattccagtcctttccttctcagacccggaagccaagggtcaggctggaggcatgaacagtctctggtctcccagtggaggagtgacaggcagggccagggcgtgggctcctggctgggtctcagctggccaagtggtcctcatgcagtgtcacctcttgtcagcttctgtgccgtgacccgtttcccagtcctctggtgcctttgggccagggtgtagcatggtgtgtgcctggcaccctatgaagcccatggtgacagggtgacttcctgagtgatggtggaggaaatgatccagagtgtcccattcccagggcagacatccttcccctggtgacgtagtccctgagctgagggtctgtctcactgcctcacagctgtgagtggagaaggctttccccgcctcccacagagcacaggctcctgtgggattgggtgtgtgcccaggccatgctcaggaacagctgtagtctgttggtacaggagcctctcgtgagtccaggcccgggcctccccctcctcagcctgcggcctgcctacccttgctgcttgaggaaggggcctgggcgggagcctggcagtagagcagtggggagccaacctgcatccagccggtctggcccgccaggaccagagacatcagcaggacgcccagctggatacaggcccccagaggaaggaggaggcgtttttgtgtttgagcccttgctgttccagaggcgtctcctgcctctgccttctaggcccttcctcaggcctctccccagggctcagcacagcagctcctcgcttcataaccttttgctcttgctcacattgttccccctcctggaaatggccttctagtctctgcatgtcgtacgtcctcctgtacagcccgcaaagacccaactcacacgtcctgtctccttttaaaatgtttcctgttcccagggcagaatgtattccgcttccctctggatgcccacagcctttgagcacaccctgcccctgctggagccctcaacctgtgggtgcactcttggcctgctgtcatttccggctctttagtatgggagccgcagcatggtgtggccgtgcagtcggggggttctccaggctgcacctgtgtgccattccacgcgctgcagacgtgactgggtgtcctcaggagctgggtatttagtgggtacaagtcctggggttcagcagaaatgatgcacagcactgcagtctgagttgggtgctgtggatgttggcagggaggaggtggcatttgatctgggatggggacggtaacagcggggtgctcgtttggacaggagcagggagttgaggtgtgggagagagagctgggcagcagcagctggaatggcagctcagggcagctccctcagggccttgcatgctgtgccaaggcctttgagctttatgttctgggcagggcaggcgtggaacctggggagcgacgtgctgagattggcattttggtaaggtgactcagggtgctctgtggcagatggatttggagggcaatggctgcaggcagggagaccaataccccagggaaagacagaaggagccctgcgctgagtggcagatggcttgtctggcagccactactggccctggagggaccagcccctggcctgggaacctgggaggctgggaggtgaggcaggactggagatggctgggtggagtgtgagggtcttgagcgagctcccaggaggaggctcttgtgggagggggcgcagatttgcctgactcaggtggaagctgggggcacttggggaactggggtcatctggccagagagggacgggtaggaggccaaagccacgcccctcagatgcttctacaggttgagtgtcccatatccaaaatgtctgggggccagaagtgtttcagatttcgatttcttcggattttggaatatatgcattatactggtcgagtgtccctaatctgaaaatccgaaatctcaaatgctccagtgagcatctcctttgagcgtcatatcggcgatcagaaagtttaggattttggagcatttcaggttttcagattagggatattcaacctgtagtacttctgtaaataccagaaaccgaatcctttgaaaaagctgccagggagcatacgatgacgttgtctgatttcaggttggcgagaattccttaggccttttgagggtcctacaggagaatcagatggatgggagttttcctgtgaatttcccattgcctttctttgtacgtgaccgcaccctgtcagccccatttagggccgccttttcatctcctcccagtagaacctggaagctgcacctagtgttggtccttggtgtgggttggggcagagctcatggagccccctggattgtggaggtcaaggccctgtggctttccttggggcctccaaggcctccagcattttctgttcctgctctgccctctgctgtgacggtgcggtgacttgagtgacagcccttactgagtctggctactggggcttctgcagcgtgggttttgagtgtgttcagggtttactgtgcccgcccttgcacagtgctgggtgagtgccctctgctcctccgagccttgtgctcagagatgttctcggcaaccccgctggcagagcccagcctgctggcctcccccttccttccccaaccccgcttgcgcagaacccacggttgtcttaataagtcacagaggtgggtggtgctgtggaggcagccaagcccagcccgatctctgttgcagttctggggcaagtgtggcctctccagggaacagccaccagccctttcccaccacacgagtcagcaggctcctagagtgatggcaatggtgaggtgtagccaggctctggcagcctggtggaaagcgactccttcttgtttatgaaaggctgctgtggtggcaggtgcctggggctcccgggtaagagcctgtggccccagcggccggagtgatgtttctgggcctcagtgtcataccgggcttgaggcatggggcttgggactggggatgcagtgcttgggctgtgctcccctgaaggaggagacccagtggagggctgagccgtgtgtcacctgtggtgcatgtctgggtgtcgtgggacttcctgccttccatgcgctgtgcatgtggatctggttttgcccaccagatggcttttaaggtgacatgcttctgagcggcccctgtgtgctgcagtcaagggcaagccttcaccgtgcccaaggtgatgagcctcgactgtgaccacagactctgttgcggcaggagcccccacatgactgaatgcaggcctcacaagccttttctgcagagggccgggtgggaagaaagttttccaccctggagcagttgatgccgacccaggcgaggccggggagggtgccaggagcccggggccagccctcaaaacccacccgctgcgccatttcgagaaagagccctgagtgctggcagcttccctctctgcctctgctgcagccatcttttttttttttttttttttttttggtcttgagaagaattttcatttcagtatccagattcatttctgtatccagatttccgaggtaaacttcctggaatattctttccctaataattaatggaaatgaaatccacgtgacacagaagtaaccactttaaagtgagccgctccgtgccgttgagcacgtgcacaggaattcacttcttccagcgcgtatagagggcccagggggattctctggctgtctccggcctgaccagctctgctgtttccctgcagggtctggccctcactgcaggacaggttcagctcactgaaaggggtcccaacagaggtgaagatccaaggtaggtggaatcttggtccattctgagcttgtccacagcctccttatggagtggtggtgcatgttccattggaccaacgttttcttttaggtggtgcatgttgtgtggatgttgctagagccttcttgaaccccacccttccctaggcatggcaggtgggagaactcctctcgcagggacctagagcacatcagtccctgcagcgctggtggccagagacagagatttttgccgatgccagcagtggttccgtctccctgtgtcagtggtgtgtgacacgctctctacaggtggcatttctaggggcacctgctgctctccagcggagcttgccttataacctcctttctatcatttcttggtagaaaccgtgcttaacctggtaatgaatgttggataaaggtgagcaaaactgcagtccccaagttggtggctaacttttcatcttcatggtgatctctctagaagttggtggaatgtcaaaggtcaaatttttcatgggcctgtgtctgttctggccactccagggtagataagctggaccctggagtcctgatccgtgccccagctggcattgccacatgagttatctggggccagttcttcctgtgctgaagtgggccagaagaaggaggtgttgttttagagcagccggtgggctggcctgggccacacagaggcactgcccttctccctggagctgccgtgtctggtacattccagattctctgacccacaccaacacatgtgtgacccgacccagcccagccttagccctgacaccgccattcccagcctgtttcctctcctgtcaagtggggatgaaacccagccttgcctacctcatgggaatatactgagtgtcaggcttgtcagagggcaggtgggagagaccaggaccagtagggtgtgaggatagttcaggaattcatccgacgaatggttaaggagcagccaccacatgcgaggcgctgttcctggtgctggggtgcagcagtgagttccactgccctcgtggcgcttgcgtgctagcggggagagacagggccagagggtgggagaattgttcatgcacctgccagcgagaagcactgggaacagccagctgagggctgagggtcctgcagggcttggggaaagggtggtgctgtcttgacataagatggcaggaggggcggaagccagcgcggcatgtgcggagaggaagagcatgcgcacagggccccaggtgggctgtgcctggcagcttggaggcacaagaaggaggctggtgtggctggagagcagggcagggcaaggagtgaggttgggaggggacgggccagatcaggccaggccatgtgggccccagaaggacgtgggctttgactccgaggaaggccgagttctgctcttggctgtaacgacacccctggcccactgtgctgggaacagggtgcccggggaagaggcagggagagcggtgtggggctcttgcagtgagtggtccaggtgaaagtttggagaggcagtgcaggaggcagcgctggccagatctggatttatagagttggctggactcgctgagaggaagagaggggtcagggaggacttgaggatgtggggttaagggcagtggtggaacaggcttgcctaggcatgcagttggcatttatatggtggttctggggttactgagtgcttccccacagactctctgcttacttcttgcaacaaaccctccagggttaggtggaggggcaggtctggcatcggccccaggctttctggctccaagttactcagaaaatgccctgggcaccctggcagatgtggctggatagtctgcagtgtgcacggcgccaggttccccatgcatgaaatggaacaaggtcttccacccccagggctgctggcagggtgatagcagatgatggcacgaaggtcctttaggacatggccagatgggagcggtgagtccatttgctttggccttgtgaggtcttggagagagtggcagacagtgcactgtagaggttcactgacccctgtccactcctcaggcagctgctggcttctgctcaaagccagagtgagtgaccccaaacctgggagagcattgggtacaattcctaattttcagacgaggaagctgatgcccagagaggggtggggccactcagcaagaggcagcgctggcacctgggtgcctgcctcctggcccaccctggtctcctatacccagtctagtctgtgggtgctgggcttcctgggtgtctgctgtcccctgctgtctgggcaggtgcctgccatgatgggctctttgtgtttcaacagaaatgacgaagctgggccacgagctgatgctgtgtgcgccagatgaccaggagctcctcaaggtaagagggcctctgtctgctctgcagacggcacgcacgctttctgccctgggcagggaacctcatggtgctggctgaggtgggaggattttcctcccctagtgcctttgaggttcctcaggccctggggccggctgggtgcccgggcaggctgcttctctaggcatccctggggccagaactgctgggattctcttgggtagaacctggttgtccctggggcgcaggggagagggcagccgtgcagggaggggcagatctctggcttctgatgaccagtgggatggaaagtgtcctgtccttggttgatgacttcattcttcattcatcccggcgcctggctcccaagcccttgtggcccgagagtttctcccgaggtccctcatctaccctgcggtaggtcaaagaaactccagcacccaccttctcgtttctaaattttgaaataattgttttcactcgatgattatgagtaatgctactataaacattcttgcatatgatttttgactgaacacgttttcttttttttatatctgaagagatttattcacgtgaccaatggcctatgacacagccccaggaggtcctgagaacatgtgcacaaggtggttgggctacagctggttttctacgatttagggagacataagacgtcagtgaatccatgtgagatgtacactggctggttgaacacgtgttttccatcctcttgggtgtatagctgggagtggaattgctgggtcacagggtcactctgtgcttaacttttcgaggagcccccaaactgttttccagtgcggcggcaccatcttccttttccagcagcagcgcgggagagctccagtttctcctcgtcctcgctggcacttgctggcatccgtcttgttgattctagccaccctgctcggtgtggggtggcatctcattatggttttgatttgcatttccccatgaccagtgatacggagcgtctttttgtgagcttgttggccatttctgtatatgctttggaaaaatttccatattcatgtcctttgcccactttttaattgggtcacttgtccagtgaggttttttttttgttttgttttgttttttttcttaattagtagacttaataatttagggtagttttaggttcacagcaaaattgagcagaaagtacagagagtctccacaggccccctgccccacacatacacagcctctcccgccatggacacgacaccctgcacacgggggctcctttgtcacagtccatgaaccagcatggacacattgtcacccaaagtccatatccagtgagtcttctctcctgtggttgagagtccgtggttctccgtgtgccaagtagttctctcgacattttgcctattactttggctctgggaaaatgtattctccacacaatttatatttgtatacatatttgtgctttagcaggcacttgacctgcttaggtttaaggagcaagttcagccgcctcccgcctcttgcctgccgttccttccagcatcagctctgtttctgcagcctttgcatggctcttcgggtcccccctgtgtgtgcgccacccagtggtcagcctgggagactttgctgggctcaccaagatcagatccacttgtgcacaggtgggcctgagcccaggcattgtaaacagatttgtggggtcactttcttgagccgtttcctctccactgtcttttggatactttctagttccctggggctcccttttcctgtcctccagacataaaccacccacttccgtgatggtggtggcacggccagctccctgccagtctgcaggagaactcggaatcctggtgttcctccctgacccacctgctgacattcgcttctcagagcctgcgagcacctgccccatacattctgcccagccgtgggagcactgcgcttgctttatatttccacattggcattgtggcaaagtgcactttacgtaaaatctgccatgtcagtcatgaaaaacaatttcctaacaggccctgtgggagctcgctgctgcttttttttttttttaatttaaaaaattatggtaaaatacacatcacctaaattgtatcatgttcaccatttttaagtgtgcggtccaggggcataagcacattcacggttctgtgcagccatcaccaccatccagccgcagaacttgttcatcttcccaaactgatacttcgtcctcaatttttaagccgcgttaaagcgtacgatttagtggtcttcagtacattcacagtgttgtatgaccaccacctctatccagttccacaacattttcatcacccccaaaagaccctgaaccactgagtagccactccccattcccctcaggccttggcagccactgagttaccatctgtctgtatgtcattggagtggaatgctggaatgtgtggcctttggtgcctggcttcctcactgagcacaaggttttcaaggtttgtccatgttgcggcagcacttagcaggactgcattccttgttatggataaacaatcaaaggaattggagaattccattggtattattgagacctgggagttggaggagggaggaaggagatacagatttaagatcattaggtagggtcaacccttgtagtcctgagttttaattgggaatatcagcatgagcccccgggcttcaagcgatcctcccacctcagccctctgagtagctggggtcacaggcatgcgccaccacactcagctaatttttaaaatttttgtagagaggaggtcttgccatgttgcccaagctggtctcgaactcctgggctcaggcaatcctcccactttagcctcccaaagtgctgggatgacgggcatgagccattgtgcccgtcctccgcatatatttttacattaagggatatatatgtatttccttatcttgtgccctgaaaatgcctagaacaatatgacaccccggctgtaatgcaggcggaaacacagagagcagcagtcacccaagacttgggtcacgtccgagggactcaggagccaactagcaatagtcagagaggggccagtgggagcctcgtaagcataggggctgcagtagacaggcacccttcacgtatgcccaaatccaggtgttcatagtgatgttttataaagtcatcaatttgacactaaaaacataagcgacaaaagaaaaaacagatcaattggacttcattaaaatgaaacactttggtccaccaaaggacaccatgaagaaagtgaagaaacagaaaaacctacagaaaggcggtaaatagttgtaaatcacatgactgatgagggacttgtatcccgaatctattaacaacccttacaactcaataagaaagacagaaaacccagttcaaaaatggacaaagtgtccgaatagacgtttctccgaagaagatgaacaaatggccaagaagcacaagcaaagatggccagcatcacgggccattagaggaacacaaagcaaaatcatcatgagatgccacttcacacacactaggatggctagaatcaaaaaagaaaaggaggccgggcctggtggctcatgcctgtaatcccagcactttgggaggccgaggcaggaggatcgcttgagctcaggagtttaagaccagcccagacaacatcgtaagaccccgtctctacaaaaagtaaaaaattagccagacatgatggcacactgctgtagtcccagccacttgggaagctgaggcgggaggatcacatagagcccaggagttcaaggcttcagtgagctatgatggtaccattgcactccagcctgagcgacagagcaagaccctgttgtttaagaaaaaaaaggaaaatcccagtgttggccaggatgaggagagattggaacccttctgcattgctgtaggaatataaaatggtgcagctgttatggaaaagtctggcagttcctgaaagatgtcaacacagttaccccgtgacccagcagttccactcccagctgtccacccaggagaagtgaaaatatacatgcacacaaaatcctgtacctgagcgtccatagaagtgttattcttaatggcctgaaagtggaaagagcccaaatgtccatcagctggtgaatgtataaactaactagcaataaaaaggaaatcaactactcatctgcgctgggacacgcgtgatcctcgccagcctcatgcttggtagtgtatgattccattgctgtgcagcatgtagataggccaggtcagtgctgtggggacgtggcagcccgctgcccccagatcaccttggagcacatgactgtggtcagcaccaccgtgcaggcagtgagccctcccagtgccatcgcccctgtcctgggtgccctgagcttctcgcacctgtgctcctgaatctgcctcagttggatgtcatggtgatgcccaggctctatgctattggcagtgttgccaattttaccttatcattgcccccgcctgccacacacttttctgaggaatgcaccagaacggactggctcagccagctgctctggcagcttccccaagcccgccaaggagcatttgtgtgacaagttggcgctgaaggcacaggccacagtgaaagggccaaggcactcccggtggcatttcatgccatggagttgacccttttgacgtggttaggatgttcagagctcaagaagtaggcctggctgggggctttctggagcaggcgtagcctctcaggtcctggggctcctcagcgatcctcttcccttttctggaaggaggaaagagctgtgcttccggaagccttgagcttctggctgggtggctcccatgggtatctcactcacctttccggcgagtgggggactaattcagccccgcaggagctgctgctcctggagcctgggccttccgggctggaacgccagtcccctggctggaaagcaggccacctctcagccccatcctgtcggcttcatctgttcccagctgggacggcgatccttggaggagaacaggccttgtcctggaggtgtccctgtgggctgtgttctgtcatagcaggccctgctgtgtgctgcctgcccacccagcaagccatgctgtcggctgcacgacagacacatatgctcctgtatgtttctgcagtgctcagcccgttctggcgtgtggtcccagcatcattacagcccaaggcagggaccaggcagggagcacttgctagtccaagacattgctgggcaggcacagggtcgttgatgggccaggcccctcctttcccctggctcctggcatgggtggcatgtgggggcaggggcactggggacagctggccttggcctggcttagatggagccagtgaatgtctgtggtcttccttgcccagggctgtgcctgcgcccagaagcagctacacttcatggaccagttgctcgataccatccggagcctgaccattgggtgctccagttgctcgaggtaaaggtgtggatggcccaggtgggcagtattgacgggcttctcttggtcctagttctggagctggtaggggctggggtgtcactccccctctgatgctggctggggtgtgacaccccacttggggatctggctggccaatcaggggccgggcagcatacgggcaaggggcagctgtgtcccaagggtgctggctgttgcccaaggccccgggggtgagtatgaaggtgggatgtgggcctcagagcagacgggccaggcacagaggagggtgagcacctagggtgctccatgggtgggtaggtaggcgggcaaaaatggaggagccagggcagacaggtggggcaggattctgcgcggtggggcttgtcctggcctctgtgcctggccccgatgtgcttctggggccttccctgtggggctgagggcctgctgggcgagtgctctggcctgtgacggtgtggccctgggggctgcctttgcagcctgatggagcacttcgaggacaccagggagaagaacgaggccttgctgggggagctcttctctagcccccacctgcagatgctcctgaatccagagtgcgacccgtggcccctggacatgcagcccctcctcaacaagcagagtgatgactggcagtggtacgtgctcctggaggcctcagtggcagcaccctggcctcctgtcccagccccaggctgcttggttctgttactgcagacacccctggcagcggtgagttgcaagtgttccctttctctccctgcagggccagtgcctctgccaagtccgaggaggaggagaagctggcggagcttgccaggcagctgcaggagagtgctgccaagttgcacgcgcttagaacggaggtgagggtgctagctcctgggagggggttgcttggaggcaaggccctgctttgtcacctccctcagcacgtgaggcttaggcgaggttgcctgtgcaccgggcctgacatgttctagaatactgtggtgctcagtccgcggggaggtgagaggtgggtcccgtggctgggggaagggatcagcctcaggtattgggtggtgcccacgcctgagcacattgccatgtgccttgccgcacgtggtcctcctggcagcccttggcctggcctctgtttgattgcggaggagaccggggcccacaggagagtgagtgagggggctgaggctgggagccagaaggtcttgctctggcctgagtcgctcggtacagctcccctgtgtccctgtttctgaaagctttcttcctcgccctgggtgtgcagtgtctgaggtgagggccggtggcagcctggctggtgggcagggcagcctcaagggactctgcctctggctttgcagtactttgcacagcatgagcaaggggctgctgcgggcgcagccgacatcagcaccctagaccagaagctgcgtctggtcacttccgacttccaccagctaatcttggcttttctccaagtctacgacgacgagctgggcgagtgctgccagcgcccaggccctgacctccacccgtgcggccccatcatccaggccacgcaccagaatctgacttcctacagccaagtaagggtgcccttcccctcccctctaaccgccccctcccctgttcactcagactgagagcttatatcctgcttgggctcaggggcctcagcagcccctgacaagggaccacagggcaggaccaggggctgggaggggctgggctgggctccctgctggccagtggcgtggcagggctctgggcccctcagtgggctggggaggtgctgcttctggtccttggacctgcccaccttagcaggcactagctaggcccagatccggtgtggggtcctgcgtgtcccagcctccaggtgctgttcctgtgttggccgcactgttgtcacgttacgctccaaaatagcaaggtccattcattcttgtggatgaccaagaactgtgccagacaggcagacaaatgcctgcctgtctgcccatgagcctgctcagacaggatgagaggaagtgggctcgtcaatgtttgcttgtttcgttgttccacatgtgagatccccagaggccaacctaaaaagccggctttagttacgatgactacagttcccacgtgcgcaactctgcccttggctcaaggattccgtgatgttcattttggttttctaagcgagaggctccgagccttccaacctctgactggctggtcctgtgagacccctcgatcagggatggtgaggccacagccctctcctgtccatttttcttgggacatttattttccccccttgccaattgctggggctgggaggacacgcagtgctggctggcatgtccctaggcatcgagggttgccagagcgacatgagagtgtggcatccccactgggccaggaagaggggacttaggtccgagaactctgattggtgacttccccgctgggagttctgtccctcacccttggctgtctttcaggtgaatgccacctgatcagtgtgagtgggggtgggaagcaggagatgccgtcgctacgtgagaccagcggcatttagtgcctgctcgctccctccctccctccctccctccctccctccctccccagctgctgcaagtggtcatggcagttgctgacacctctgcgaaggccgtggagaccgtgaagaagcagcaaggcgagcagatctgctggggtggcagcagctccgtcatgagtctaggtacgtggctgcccacctggccctctgcctggggctgccccacgcacaggcttccttttctgtgctccactagccctggaggagcatttggggaccggccccttcttttgtttttcattttctaatgcatgttttccttcacttgaaaaaatgctttcagcggattatcaaatgaaaacgctcatcgtagaaaattgagataactcagtaatagaaaatgtgaagcaaatgataacaaatgcctgaatggaatagtatttgacaattaaaaatgtaacttgggccaggcgcggtggctcatgcctgtaatcccagcactttgggaagcagaggaggatgaaccactttgagcatagagatcagcctgggcaacatggcaaaaccacgtttctactaaaatacagaaactagctgggcatggtggcgtgcacctgcagtctcagctacttgggaggctgaggtgggaggatcacttgagcccatgagagggaagttgcagtgagctgaggtcacgccacagtactccagcctgggtgacagccagaccctgtcttaaaaaaaaaaaaaaaaaagttacttaaggaaaatgggaaaaggcttataatgagggccatcttctcagagttgatttttgcatatggagtgaggtggggatccagtttcctcgtatcctatatggatacacatttgtcgcagcaccattgactggaaatcactctttctctcattgatctgcaataccatcactcttggtaattattaagtatccatatgttatgtgtgggtttctgggttctcctctgttccattctattcctttttttttttgctatccctgcactaataccacgtttcagggggctagaaaataaacagcaaaataaacccaaagaaagaaggtaaagccagttttctacctcttctaatttattttttaaataacagctctactgaattcaagttcatataacataaaatttacccttttaaaagtgtacaatttcatggtctttaggatattcacagagttgtgtaaccatcctcttatcactatctgagtccagaacatttttatcacccccagaagaaaccccatatgattagcagccattccccatccctccctagcctcaactcctggcaaccactgtcatagagacgctgtctgtctctatggatttgcctgtgctggacatttcctataaatggaataacaatgtgtggccttttgtgactggtgtctttcactgagcataaagttttgtaagggttatccatgtagttcattccttttcatggttgaataatatttgattgtgtggatatcccacattttgttgtagttggtagatgtgggtttctactttttggctatgtacatcgtaagtcttttgtgtgaacgtatttttctttttctttttgagatggagtctcgctctgtcacccaggctggagtgcagtctcagctcactgcaacctccacctcctgggttgaagcaattctgcctcagcctcccgggtagctggggttacaggcactcaccaccacgcctgactaatttttgtatttttaagtacagatggggttttgccatgttggccgggctggtctcgaactgctgacctcaggtgatccacctgtctcggcctcccaaagtactgggattataggtatgagccaccgcgcccagcctctttaactctgttttttaaagttattttttaagtggttggctttagaattacagttagcatcctaactgaaaacagtctagtaccaaatgaatttcaatagtatacagaaactgcctcctattaaagcaaaatgtatttgtgggtacaccattttaattcccttgttggttctttaacacttcttttaaaagttatttttaagtggttgtccttagaattgcatttagcatcctaactgaaaacagtgtattaccaaactaatttcagttgtatacaaaaactttgcccattagaatgaagctgtattaaatgtgtacattggtacacatttttatatttatcgatgttgttacctttgttggagttctttatttcttcatgtggatttgtgttactgtctagtgtccttccatgccatcccggaggcctacccttagtatttcctgtagggaaggctcactagtgatgaactccctcattttttatgtgggaatgtcttcatttctccttcatctttgaaggatagttttgctgaatatagaattcttttgtactttgaatgtgtcatttcagtgtcctctggctgccaaagcttctgatgcgaagccagctggtatatgatgagtctcttcactttcttttcaaaattctgttggtccctggctttggacagtttgattataatctgtcttcgtgtgaatcactgtgaatttattccattgggagctttttgagctttgtaaatgtgtcgtcattcatgtttttcatcaacactcagccaggtagttgacagctctttctccttcacatcttgcttgctcagagcctcaaggtcagccagaggtgagagatcagggccttctcaggtctctctctctgggattttcacagcccggcacacacccatggtcttccagattcccaggactgtgccagagctttccagagcctttgtggacatctgattttccagcctctcctgagcttcttgtttagtctcttgtttgccccggctattatgcactgcctcaggcagcagcagctaaagcatttgctgtaaatgttttccactgttgcacccccaagtagtggtttcaggtccatagcctctgagccctagttttggagactgtctttggatgaaccctccagccagccgtctcctcggagagccaggcttctcactgctcttggcctcggcacataactaccccatgtataccaggcactgaggagcctcttcttgccaattgaactgcagcagaaccctccactttaaaatgtattatagcgtttatcctaatcaccagtcactatgactctcttcccagtttttataattgctgttagtaaactgcttataatctatgccatcattcttataatgatcattggtattcgcaacagtgtgccatctcacctgtgactgtggcaccataggactggtggcaggtcttgcctttcagaaaggccccttatcgcttcttggctaagatcaagtgtagtatctgttcttaccagaaaggcaccctttacatccaggccgtgtgaactgggcagtgcgttgtgtacagggaagtgtctcttcacccttgagccccggccactttgggggtctggagagacgccaggggagcaggcctacggcgggcatcggcctctctaggggctctcaactcagctcccatcagttcagcatcctgatgtggcttgagatgaattcttagtgtctggacacaccagagaaagggtcagcatcaaatccacgccaaaggccactcgggacagttctttatttgtcccgtttcccatctgaccccttgagggccgtggtctcgatggccctcctcccgctgtggaaggccgtgtttctgtgctgtttcacctcccagcgatctgcatgcccgcagccaggctctgttggaggtgcggcaccacctatgaagtgaggagcagccagtgtgccttctgggctcttgctgggggcatggcctcatgtgagttgggagggccttggcactgtggatcagcaccacacaccaggagtcgccccccaggcttcctgaaacctcactgccatgaaaacatcaatgtatttagaaaccgaagcaatgctgtcagtgcaagaatgggacaggagagttgagggtaccaacagtggagagatgccaccaaccccggcagtggtgacgggctcagcgggcggggaaggtggcagcctagaggacagcccaaggggcagcggggtgccagggacagggcagtggtgagcagatggaagcagagggcacaggtgaagcaggtctggagaggcccacctccccggcgagaccctagcctgttcttctgtgaagaaagtgatggaaatgaataagcaaaccagctcccaagctggtggcccggctcacacagagcctgagcggctcccagctcgtctcttgatgtggctgatgtggctggcggcagcccgggtgaaacctacctttttgcagcctctgagggtccatggggcaagagctgatccctgcctcgcctccatggaactcctccaaactgtcctccagagagagaccccacaggcaacggctccaccacagcagaccaggggcagtggcagctacccagatcctcttcccagcccctgtggctcgaaaagcagccccatgcaggagagaaggaagccctggatgagcaggaaatctgacctgaaggactttccgacaccactgaatacactcagtgcgacatccagacatgcttggacagctgtgaaaacccagccacaaagagactagaaacgaagtgaggctgggatctctaagaagagagaaaacagagagaaaaaccagcacaaagatcagcatcacacaggccccagccaggcacagggtctccagggcaggggacaggggagatgaagggcagggctccggaggaggtgggcacacagtacaagccaggtgagtgcaggcgccgagcacagggtagatggaacccacctcctgccatctggagtacaggggccaagggctggggccaaagcttcaagagagacagcctgtggcctcagaggagcagccaggatgccttacaagcactgagggccctgcacacccggccttgggctctggaccctgccaagccctgcaccaagagtgagggcagagcaggaaggccgggatggaggtctagacgatttgataagggcagatgccacacgagggacacagtccggagcctaggaagacagtctagagcagtgcgcattgcggcaggaagcccctctgctgggatgccactggaagctgatggcgagtggagagggtcctggggcgcaattccaggcgggctgagcacattccccagctcggtgtcaccccgaggcacaccccaggattcctgagcttcagagtcaccctcgggatgggcagaggatgacagattcagggttcacagcacttaatgtcaatgctaatgacttcaacatgtaaaaggcaaagtctagctgacagtggggccacggatggggagcggacaggcagggcaggtgaggggctgtgtcctcctctgtctgctgggggagggggatgatggccatggtctagggttggcaactgagaggcagatgtggtcatggcagataaggtcagcgcagccaccacggtcgccactgggccgggcagccaaggcttagggctgtctgtgtgattgggtttattgtgtgtgcagtgttctccatctggttaatactgaacgtgccactgaagtcaggacagcccctgcctcctcactgtgtgccatgtgctgcccctggggcttggggggcagggggcaggtgggcgggggcacagccgggtcaacagaccctggcctgggtctcggaactgtgctgcggtcggtgtgacccagcccagggctcccaagctgctggcctggtccccacagagcctgagcagctcccagctcggcagtgcctgtcccttccctgccatcctggtggtgcctggggctcaaggaggatcagctgaggacatgtgccttgagtggtgggcaggaggcacctcgcctcttgcgccaggctcgctttcctgttggtttcttttctatttatttatttgtttattttatttatttattttatatatatatatttttattatactttaagttctagggtacatgtgcacaacgtgcaggttagttacatatgtatacatgtgccacgttggtgtgctgcacccattaactcgtcatttacattaggtatatctcctaatgctatccctcctccctccccccaccccacaacaggccccagtgtgtgatgttccccttcctgtgtccaagtgttctcattgttcagttcccacctatgagtgagaacatgcggtgtttggttttttgtccttgcgatagtttgctgagaatgatggtttccagcttcatccatgtccctacaaaggacatgaactcatctttttttatgggccgcgtagtattccatggtgtatatgtgccatattttcttaatccagtctatcagtgttggacatttgggttggttccaagtctttgctattgtgaatagtgctgcaataaacatacgtgtgcatgtgtctgtatagcagcatgatttatagtcctttgggtatatacccagtaatgggatggctgggtcaaatggtatttctagttctagatccctgaggaatcgccacactgacttccacaatggtggaactagtttacactcccaccatccttttggtttcttttctttcctctgcagctaccaagatgaatgaactaatggagaaatagaaagtcttcagtgatggcctacgccaaagcacaggatggggcgggcaggaagccctctcccaagatcgagttggccgaggatggatgattgtggcagcagaagccgttgcagccccacgttgtgctctaggcagggacctttggcccctttggggagggagagacagacgggcggtttgacttggacacaaagaaagccttggtttctaagcagttgcctccagcctgctttctgcttcctcagctctatgtctctctccttccccttgtcctgagctgctcaggtggcccaggtctgggcaggctggcggcggccctcctgtcatcttggcgggcctgggctgcgtcctcttcctgtggctccactcctccctgctgctgccagccacttgaaagcagagaacccactgtcgcctcccccggctggccttagggtcctgtgcgagacgcacccctcagccgccctccttgagtgcccctggatcccccgcggggtaccagtttcctgctcctccctggctgggcgctcagctctgggctggggaattcagcctgactggttgtccaggaagatgctgtctgggcttcccagggtgacccagtatctccctgagcagtgtgcctgtcacagctgcctccctccctgtgagtaccggaacaggcgtgactggtagggcctctgcctccttggggccattgtacctgctgctgcccgccccaccctgctccctcctggcaccatctcctttgcttccccaaggtccctgtgggcacacaaggcaaggaggccaggaggagccaggtgccagacccccctccatcccagtcgcctgaggcatcccccagccaccactgtgagaggtgggaggccgggcaggcctgtggtcaccatggtgcaggtgcaccacctgatttataggccaagggactcctcttggtcacctctctgtgcccccagcatggggctggccctgcagtgcacccaccatcaagggctgttgtctcttgctccagaatgaggtcttcagggcgccactgctcgcaggaccgggaaggacctggtgccctttgcctggagcgggatagacagggcaggtccctgagcctggggtccgaggggctgggcttcactcctcctgtagtcccggcgctcctggcccaccccctaacgttgcttatctgtggtggaggaagcattagctcagctgcggcctgcacagctcccgggccaggcccacctcccttccttccccagcagccactgttaggtgcacggtagacatgatgaagcgacgtccttaaagcagatagcatctcccgaggctgccccatccctaggttttgggggagcaccccttcccctttggaggctgagcacggcatgtgtgggcaccttggtcacactccagagctcgcttcatccccacgagcggcacctgatctccagtgacggggagactgaggcctggcaaagaggacctgttgcctttgtgtaactggccccagcatgggggaggcattggccccagcatgggggaggcattgaccccaggcctgccaggcctggcagccacagcctggctaggtggaggttactgccttccgcaccactctggcttcctccccgtgcctgtgaagagctcggggcctgcttcctaatttgtaaacacggggcgtgtgtctcagtggctgtgagctagcgagggggtggcgagcgagccggctgcgcaggtcctgaggccccaggcctcattgttggccaacaggcagctgggggcgggctgcggccgctgattaaaggccgcctagagcagcctgtgtggcgacaggtgcccagaagcccaggaagccggtcagtgcccgccccaggtaagctggtgtggtggggttggcaaggacagtctccccgggagcctgggggcaagcaggcagaggccagctcgggaccagcacctgtgtgccagggacaagggtggggaggtcgagcccagcgggagctgggtgcactgcatgggctctttcgggtggctgcttgcctgcttcccggcagctggttccagggctggagacccagtgtgctatgccccaggttcccagccaaggcattccggtgaaggggctggaccccgccaaggtgcggtccctgagctgcctctgcctctcccaatccctgctggggactgtggctggaggcaggcagtagagcgctctgaggcctgccttttctgttcagtaggtgacaggagtggggctgacgctcccagagccaaaggtcacaggtgctgtggtcgggggtggcaggaagtgagccccagaagggtcagagctttggctagggggaggatggtacacagcagggcccgggcgaacccctctctccagtcctcagggtttgtgcctctcgctcggacagtttgaggacttgctatccccgtgggaacatcaccatgtccgaggcaccccgggccgagacctttgtcttcctggacctggaagccactgggctccccagtgtggagcccgagattgccgagctgtccctctttgctgtccaccgctcctccctggagaacccggagcacgacgagtctggtgccctagtattgccccgggtcctggacaagctcacgctgtgcatgtgcccggagcgccccttcactgccaaggccagcgagatcaccggcctgagcagtgagggcctggcgcgatgccggaaggctggctttgatggcgccgtggtgcggacgctgcaggccttcctgagccgccaggcagggcccatctgccttgtggcccacaatggctttgattatgatttccccctgctgtgtgccgagctgcggcgcctgggtgcccgcctgccccgggacactgtctgcctggacacgctgccggccctgcggggcctggaccgcgcccacagccacggcacccgggcccggggccgccagggttacagcctcggcagcctcttccaccgctacttccgggcagagccaagcgcagcccactcagccgagggcgacgtgcacaccctgctcctgatcttcctgcaccgcgccgcagagctgctcgcctgggccgatgagcaggcccgtgggtgggcccacatcgagcccatgtacttgccgcctgatgaccccagcctggaggcctgagcaccagggccacctcctgtgccatggacagtgccagcctccaccgttcagctggcctctaccacccccggctcctcctatctgggcagcctcaggtccgtgcacctgccaggccttccctggctgcctgaccagccatacggccctggattcctctccaggccccgcttccagggccgtgctctcccggctggcctgggtgcccagcagagtttgctgtttcccaataaacattgccaactactcaccctccgactagctggccagatactaggggctggactccctcgaccccctgctgagcagggccaggcggtgagccatgccaggggccagcacaagacctccagggccgcccccctatggcctctcctcgcggtgaggaccgtgggtggctgggtagggagacgtcaagctcttgggttggtctgagggctgatgggttgtggctgtgggctgattgccgcccatctgcattgtcaccccagaggcccaaagaagccatgagtagggccttaagcccacagagccggccgcctgcctgggcacaaagctcagctgcagcgcttgcccgccgtgggacctggagtctctgtccctgctctgtgaagtggtaacagggtgaaatgttaagaaacggggtgctggggaaaagggaggtgcccccacatgtgggcatgcacatgtacatgtacatgctaagggccctgacggtgcacggagcagaggtggggtggctggtgctgtgagggtgaccctggaagggagcctatcctgcagcccgtgtccccgtagggccaggaggccgctcggtgggagggcagcttctggccaccgcactgtgctttgggttccctgctaacctgcctcaggggccccaccctgaggcacttccagtcttgggaggcctcatgggtggggagagacctgtcaccaacgctgggtcaggtaagaagggatggggtggccacgcctgagagtgactcacatgagcaaagcctgagcctccagccagctggacaatctgggaagccctaagtaggtcagaatgactggagccactgcagcgtgcacggtggtaggatggtgaggccagagcacaggcagtgaccacctcagaccttccttgtggcccgggccaggcctgaccctgatggcagcggggagccgcggagggtcatgagcaggagaggggaaaagtctggtgtaggcttctgccatatgctgcttgggctgcgtgccgagctgttctcgagttgctgtgaagaaatacttgaggctgggtcatttacaaagacagcgggtttattttggctcagcagtgctggcatctgttaactggtggggcctcaggaagcttccacttatggcagaaggcaaagggggagcaagagagaggcggggaggtgaactcacagcgagaattcaactccttgcggaggtgaggacggcaccaagccattcatgagggatccaaccccatgacccaaacgcctcccaccaaggccccacctccaacattgggggttacatctcaaactgagatttggaggggacgaacgtccaaaccacatcaggctgctgcatggagaatgggctggagaggacagcgacggcaaggcgggcagaagcagagcatggagggctttggtggagggagggagagctatgggcctggccaaggacagtggcagcaggggaggggagggggcacggtctggggaagccccacaggacctagtttgggaatgtggttagtaaccagaagatcttgtcacagccaagcttcccgaggagagcatcacctgggagagtgtcacaagccctgggctggccctacagaagctggagtaggggacactgagcccccagatcccctggtgcccagacagggcctgcttctgtttatcttactggccaggctccagctgggcagccgaatccagcaggtgttacccttaaaaccctggccttggttgggcatggtggcttacgcctataatcccagcactttgggaggccaaggcaggcggattgctggagcccaggagtttgagactgaccggggcaacatagcaagaccctatctctacaaaaattaaaaagaaaaattaggagtggaggcacacatctgtagtcccagctactcaggaggctgagggccagaggatcacttgagcctgggaaagtgaggctgcagtgagccatgatggcaccactgtactccagcctgggcgacagtgagaccccccttccaaatccaaaaacaagaaaaaaaacctggtcttgccactgacctgctgggtaggtgacaccaagtggggcccttctcattgggcatgctagaagggtctcaaccccaggatgggacagacaggcaggtgacagcctgattttggctgctgccgcctctgtggaggggtctctggttttgggccctctcacctgtcttgggctgaggtgcctctctctcatcactctgggctcccctggcctcacggtggcctggcctcgggcgccctccccgagtccatgtcgagactggccaggccaggcgtcttgcgtaccatgctgcccagacaggctgtgacctgcctctctgatgcctcaaagcagcaatgtgcttataaatggttaacaaccagctttccaggaaaggaaatgtacacgtatgtatgtaggcatggatctctctcccttcctcccctgtctctttctctatatacacacaggctatacacacaggcacatgcatacatatacatgaacacacaatttacaaataataaaatccacaatatatataaaatatgcaacaaaatacacaatatactcttcgccgtaaattccacatggccaatgaatactcacaaaataccttcattgacttttactgagttcttgttatctgtaccctgtacttgagtgcgatggatggacagctgtgcttcccacatacatgttggctgatgttttcatttattttaatgagtaagataaacatgaagcagcaaagatgagcaacttctttgcttaattggatgatagttttcaaataccgaaaatgtttatttttatttatttttttgctatttataatgtaatggccgcagacccagcattcttcagtttaatctgcaatattagcattttcttcacctctttctaaagtctaggcaatcaacaaagcagtaatacatcaagccctggcatgccgtggcatgccgagctctgcggtataatacttccacttggccagtcttaagctaccaacaggaagtcactgaaggtgaccttgggaagagattccaggatttccaccacacacatctgacaggtgtcaacacacagcaacagtaaagcatgctcgaataatgaagacgtgagttttgagtatctcctttatttttcatataatttgtcagtttacataatttaactttttaataatgatagtgtttgtttagctctcaaaattcctggacgtttaacatctattagaatgggtaaaacaaaaaccactgaccacaccaagtgttggtttaccagggaggagatgtggagcaccgggggtgcccgtgcctttctggtgggaagggaaaatggggcagccacttgggaaaacacttcggcagtgtccgaaaatgttaaacatgcacctaccacatcagccaacaattcccctcctagatacttacccaagacaaagggattgatgtaaccatacaaacactcatactccaacgttcacagcagctttttcataatagccccaaacaggaaacagcccaaatgttcatcatcaggtgagtggttggacacgccgcagtgcgtccacaccacggaatactactcagcaggaagaagtgagctcccaatgtgcaagctcatttgcatgggactcaaggtgatgctgtggagccaacagcgaaccgactccactgctccagctcgcccctggccagctgcctgcccctcatcaagctgcatcactgactgatgagccccgtcaggccaccaggggtgtctgccagtggggagacagcggtgatcacgggagtgtacctgggggacatgtgacataagcctattgaaaatggaattcactatggagagggatgaatactaaaatcaaaggccataacatttccagtttgtctttgtgcggaagacaatgtggggagcacgctgaaagccgcagcagaaggttggggagtgccacgggaccacagcgggacgtctgcatttcttgtaaatgatatctgccccctgcctgttgcaaagaagttaagcagcattgatgagtgtcagctgcggaggtttcatgtaggggacctccaggaacagtatcagcattgtggggacactgcttcctatagctcagcttgtgaacacacacctcccactcacagatgtgtacactcacacacttgcatgcacacagacacacttgtgcacacaccctcacatatactcaagcactcacacacccgagcacacccccacacttgcacacacacatgcacacacctgcacacatatttacacacagtacacccacacacgctcgcacacactagcactcacacacacctgtacacagttgcacacacaaccacacacatgcacaaacacttgcacatacactcactctcgcacacacttgtacacactgtgccaatccattctagacttgtatttgccatttaatgtctcttgagcatcaacctcttctaagggattcagctgggacaagaacctggggagtattacttgcattttgtcttagtccctatgggctgctataacaaaaatactttagactgggtggcttataaacagcaaacagttattgctcacagttctctagtctgggaaggccacgatcaaggcaccagcaggttcagagtctggcgagggctggttcctcgaattgtggaaaggactagctgcctcacagggtctcctgtaagggcactaatctcattcatggtggtgcagccctcatgacctactcaccttctaaatgccccacctcctactactgtcaccttgttgattcagttttaacatgaattttgggggtacacatgcaagtccccactcccccaccacatacacatgcaccccccactcatacatcacatacccccacccccacaacctatacatgcacacacacacatttacacttgtgccacacacactcccctgacacacacatgccactcccacacactcacttgtgatttggcataaggcactcgaaggctgcaatttccctctaaatgtagatttttttggaatcaaaatcatgttctttaattgccttttatacttggtatcatgctgaacataaattattttaagttgcagcatagacatgaatccatttacagcacggcatttcaatcaaaatactgaggaagacagcatatgtgtgtctgtgtatttattttgtgcatggacattttttctaatctttaaaatttatccagtatatcttttgggtttttggagtaaaattggtgtgttattattgatatcagcaatatcttccatgatagataagttaaggttttatgaagttttgaaaacttttgaaaaataaatttaatacagtttctgataatttctttaagatttcagaaagtcaagagtgtacagatgttgatcctcaggagcttcatttacctggcccatcactgaagaggcagaaatggaagaccaggctgagggaggctgggaagaggggtatctggaggctgaagaggaagacgatgaagatgccgaggaagaacaagaacctgaggtgacggcagctggcagtgagtgtgggttttttactttacagacacaccctgtggcattcttcttgatatgggaactaacttgtaagagaaacgcagtttctccatggtttttctaaaaggatctgatgttctcctggtggtctgaatttgcattggctgacacttgagggagctctcacaatggtgctagtaccactcttacgcgtttgcagtgcacgttcagggctgaaaagctctggaagcaggtatgtcagttcctgctccagggagcctcatgcgttaaatgacacccatgggtcactggataaggtcattcaaaatatatcctctgggggtatccagttgtccatcagcctggcagatctctgcgtggtgacgaagagagctgctctctatgcccattagaagagccaaattgttttccatgtgtcgaacttttaaaattacaaatatcacccactgactacgttcctatttcaatagggagcagcagtatatgtgggcatagtattggctgggtgaatacaatttcatactttcatattccaaagctacagatagtttttagaggtaattatatgtttaaagggaagtgtccaatctttttttttttttttttgagatgaagtttcgctctggtcacccaggctggaatgcaatggcacgatcttggctcaccacaacctccgcctcctgggttcaagcgattctcttgcctcagcctcccgagtaactgggattacaggcgcatgccaccatgcccagctaatttttgtatatttagtagagacagggttttgccatgttagccaggccggtctcgaactcctgacctcaggtgatctgcccgctttggcctcccaaaatgctgggattacaggtgtgagccaccatgcccagctgaatcttttaaaactttgatttattagtatcttttgagtgattcgggtattttaaattaaagtgtgtattcaatctgtaccctaaacattatggccagtgatgcgtttggtgttgaaattgtatctatcaataagcttgacactttattatcgctaaatgcagattttactgtgtcctataggtttgctattaaacattcttctttgctttgctttaggaatagcttgtaattttgctttccattcccttcttgatctcatgcttatatactgcagtttatcttaatttctgagtaattatgatttcatgatcttttttttttttttttttttttgagacagggtctcattgtcacccaggttggaatgcactgtcgcaatcttggctcactgcaacttccgcctcccgggctcaaactatctttccacctcattctcccaaatagctgggactacaggcatgcgccaccacagcctgccaatttttgtatttattgtatagatggggttttgccatgtttccctctggtctcgaactcctgagctcaagtgatcaaccctcctcggcctcccaaagggctgggattacaggcatgagctaccacacccagccagtcatgttttgttgtgtattttagttgtattggataataatctgaggatgtgttgcttaaaatatcaccttttcgaattaaggtagtttgggggctgcttgagttctctagggatgccatagcaaagttccataaactagggggcttcgacagcagaaatggactgtttctcggatctggaggccagaagtcagagatcgaggtgttggcagggcaaggttccccctgggggccgtgagggagaatctattccaggctctcccccagcttccgggactttgctggccatctttggtgttccttgatttgtggcagcctctccccaatctctgccttcatcttcacacagccctctttctccctgcatacaaggcgctgtgtccacatttcttctttttataatgacacagtcatattggattacagcccaccctaatgacctcattttaacttgattacctctgtgaagatccccaaataaggctccattctgaggtactgggggtttgggctgtaatatatctttttttagggggaggagggaggcagacacaattcaatggataacagaggccgaatacataaataactgtaaaatatgttatagactctgaaaaatgcacctgcttcagagatgcaggcttttctatatatctctaaaatctagttgacaattgtactattcaatttcctttacatttttacttgtttttttttttgttgactatatctgtctgatttaatgacaatatattagaacattccattgtaattgcattttcttgaagtcttccttcatgtctagtcatttttctttatgcatttagttgctgtgtgtttgtgcttactgcattacaactgtattaatacacacacatatatatatacacacgctctaacacacatatactcatgacacatatatactgacaaatacttgatacatattatagccaggcactgtggttcatgcctgtaatcccagcactttgggaggctgaggcaggcagaacatttgaggctaggagttcgagaccagcctggtcaacatggtgaaaccctgtctctactaaatgcaacaaaaattagccgggtgtggtggtgagcctggccaacagagcaaggctcggtctcaaaaaagaaaaaaaaaatcccaaaaaaccacaccaaaaatacacattatatccacaccatgtatatgatatatatcatatcgtgtgtgtgtgtttgtgtgtgtgtagagagagagagattttaaggaatcagctcacgtgacatggaggttggcaagtcactggacactcagggaagagttgtttgagtccaaaggctcgagttggaggcagaattccttcctctttgggtgacctcagtcattttctcttaatcccttcaactgattggatgaggcccacccacagcatggagaacaatctgctgtacttagtcttctcatttaaatactaattttatttaaaaacaccctcacagccacatctagactggtgtttgaccaaaactgggtactgtagactggccaggttgatgcataaactttaccttcccagtcactatagcacggtctggtctttgttctctggaattttcttcgtgcgtaacacccacgaatctgtacttgatccttacagccagcccagccagcccctctgtcatcacttatttcaattgagcgcatactttgtgaggtggctgcccaccgccccttcctctctgaggcctctgttctgttgcaggggttgtttggtcttgcagctttgcagtgagcagatgtttgcagaatgtaaccgactcaagtctggctgcttgctgtttggaggccagaatacaagaagcgaggtgtggtgaaaggaaagccgtttttgttttttgtttttttttggcagaatcttgttctgtcactcaggctggagtgcagtagcacaatctcggctcactgcaacctccgcctcctgggttcaggtgattctccttcctcagcctcctgagtagctgggatcataggctcgcactaccatgcctggctaatttttgtattttttgtagagacagggtttcgccatgttggataggctggcctcaaactcctgacctcaaatgatccacccaacttggcctcccaaagtgctgtgattacaggcgtgagccaccactcctggccgaaagcagcttttactcgagtgctagcaggtgggagaatggccgggctggccaggctcaagcctcagaggaaccatctcaagctttatgtgggcgagaggagtaaaagggagcttggaatgggagacatgcaggcggggcactgggcacaaggtctgtgtgccttgttcccttggctatcttgagtcatggtccactgggagcacgggctggcatcatctctacgatggctgggttgtagactgaccgcctggaatttcacagctagatttccatgcttggtttgtctcaagattagcgccctggaactactaagtaagcacaaaattaggtgagtgagcagtgcaagggagtgtctggtgggaagggagggaaacaaggagtttcaaagtacattaaggctgaaagcaagaaaggaaagacgaagtttcaaaatgcatttgttttttgtttttttgagacagagtctcgctcagtcgcccaggctggagtgcagtggtgcgatttctgctcactgcaagctccgcctcccgggttcacgccattctcctgcctcagcctcccgagtatcaaaatgcattttgaagctaacctgcttggtcacaaggattcttgctttccttccctgctgggtgaggatgaggatccacaggctgccagagtcgcacagggaagctggcccactctgatccatttctgctattgctggttctttctgtttggaagcttctgagatgctcctgctgtcttgggagcttgggaatgtttgtcaggcaaagcccaggtccatgacaatccggtttggagtggagctcagctagccctcctgaggtggagacgggcctttgcctcctctgggaggccttcttcagtcaagggctgacccgtctgtcctctgcccctgctcctcacttcttgtcttctggccagcatcctcccaatttccatcttcttgtttctagctggatttgtagaagcagcgacaaccccttaagtggcgtgaggtgtgatagtcgccacagtcccagcggaagccccaggctcctgggttgtcagtcacccaggtacctccaggggcccagcgcattccgggtagctggaggctgatcctcgccccgggccccggatccatggcctccgctcagcccctcccacctctggaccctgctccccaccctgggcgctccacccctgcatgtactgggaagactggaggtcctgccagcccggggagccctctccacaatgcgggaaagaagacaaaggtgagctcagctgcaatgggcatcacaggccgagaaggaaacctcatcctttgcgcagtgcatgtcagctaccctttgatctagtcaggcagatgccatctcaagatgccctgctgcatgtcctcatccatcgtgagtgcacctggtcagcagctggccattctgcgctagtgagttgcctgtatccaaaggaaaatgaaagctttctcttggtggtctcaggaaggcagggagctaggggcgctagctttatgtttgcatttcaaagagatgtgtccgggtcctgcagacacacctccctgggccgtaagcctggcggggctgtattgaaaaggtttacaaagtctccttccaacctggaaatccagcacgtacagcattccccctcctgccagggaacccggaagcccggcaaaagaacccttggcatttcccaggtcccctggggcggagaggaggacttggcgtttgtggttccctccctcgaggtccagggctgaaaggcacccaagccgttgggagggggcctcagctagtggtgacagcctgggtgccaggcctcaccccccagctgcccaaccctgtggctggcagaaatgacctcacagcctggcctcagtttcctcatctgtaaaatggaaacaatacaatgatcctgggagggtgggtcatgcctggggcctggcacatagcacatgtgcagtgcatgtcagctacggtgacagctcctgttatgtctgagcccttgcacttcttgtcatgccctccgagccctatatggctgtccctggccctgccaccctcatccctccccactgcccctgggaggcccactggcctccagccacacaggcctcaaacacaccaagcctgttcctgcctgtgctgggttgaaggcagcccccaaaagatgtgttcatgtcctaatctctgcccccttttagtgtgaccttatttggagaaagggtctttgcagatgtaattacattaaagatcttgagacagggtcatcctggattactggagtgtgccctaaatccattgacaagtgtccttaggagagacgcagagtggaggcacacagtgggaggacgaggccacttgaagactgaggccgggattgcagcgatgcagccacaacccagggaagtccggggccaccagcggctggaaaaggcaagggaggggtcttctggctcttcaacaataagagagtaaatttctggtgttttaagccacctggtttgtggtgctttttccttccttccttccttccttccttccttccttccttccttccttccttccttccttccttccctccctccctccctccctccctctctccctccctctctcccttccttcctctctttttctctccctctctcctttttttcttttttttgatggagtcttgctgtgtcgcccaggctggagtgcagtggcgtgatcttggctcactgaaacctccgtctcctgggttcaagcgattctcctgcctcagcttcccaagtagctgggactacaggcatgcgccaccacacctggctaatttttgcatttttagtagagatggggtttcaccatgttggccaggctggtctcgaactcctgacctcaggcaattcacccgcctcagcctcccaaagtgctgggattacagatgtgagccaccacacctggccccctcagtcttacagaaaggaaacgaaggtgcatggcatccggagtgagcaattgtgggtaagggatggaagaaagtgcaggtggcagggctccagggcccacagccccagcgctcctgagggtctcaccagctgagaacctatatggtgcaagggcggggagggggatgaccaaacgctttcccaattccaaggcaggatttaacctttggcttctttccttttgtacaatcttttccagaaaatcaaatgatttttatgtttggttatggccaacttatggaatcatccccccaaatgggcgaagttaggaaaatggtaaaggcgactggattccctttagtttgggggcagagttcacacagctgctctccctgattggctggagtgagcagcaatgctggagtcctggaacttgggcatgaatctgtcgccgcttcctagtgttgagtctccagacaattccttcccatctctaagcctcagttttcacatctgtaaatggtagtcaggatgccggccagtgggaggggcttgagcaaggctggccttctctccctcacccccagcctcccagagttcaggcataaagagctgagggccctcgggttgatatctaggtgtgggcagggctgcgctccctccagaggctctaggggagggtccttctgcctcttccagcttctggtggccccgggtgttccttggcttgtggcctcatcacttctatccctgtctctgtcttcacatggccttctccctgtgtgtctgttcctttgcatggcattctcctctctttgtaaggacagcagccatattggattaagggtgcgccctactccggtatgaccttattttaaatatttacatcggcaacgaccctacttccaaacatgatcacattctgaggtactgggggttaggacttcaacctacctttttgggggatacaatttgactcataacaccacccaatctgcatcctaacctttttctctggggataagaccccaactttgttcaaggcatcagtgggctcagccccaggtgataggtcatgaaaatccatcccattcccaacgttctcagcctctcttgaggttaggggtggccgcatgatccagttctggctcctgagatctaagtggaagtctgccaggcaagtttctgggaaaactgttgcttccttgataaaagaggacagagtgtctgtctctgccccttcctccttctgtctaatgcatatgtgatggctggagcttcagcagccattttgtgatcacgcagcaaagcgaagcaaatcagaaagatgctgcgtactgccaaaagctctgctgctgaaccgatgccagaaagctaccccagagtccttaggtgagaaaacaaagcatctaattctttaatccaccatagttaggttttctactacttttgtggccactttcctaactgatatactgtgtttgtttcttcctgcatcccattcccataaccagaggagaccctgtgatctgagtgttcagtcactgcagtcaagctgctctccttctcacctgtgctttcctctttcctcctttgtccttctctacctcctctcaccttgttctcatgtaaccagctagaatacattatatagtaggcgaggaatattttcattgaaaaaaatgaaaaaaatttaattcttactttcttattttgatttgatttgatttgagctctcacagttctggaggctaaaagtctaacgtcagggtgccagcagatctggttcttggtgaggttctgtcagaagcccttttcagaaaatggtacttaaaaaatcttggagcctgggcaacataatgagacctcatctctataaaaaaaaaattaaaaaatcagccaggtggctggacgaggtggctcacgcctgtaatcccagaactttgggaggctgaggcaggtggatcacatcaggttgggagtttgagaccagcctgatcaatatggtgaaatcccgtctctactaaaaatacaaaattagccgggtgtggtggcaggcacctgtagtcccagctacacgggaggctgaggcaggagaattgcttgaacccaagaggtggaggttgcaatgagccaagatcacgccactgcactccagcctgggtgacagagcgagactcatctaaaaaaaaaaaattagccagatgtggtggcacatgcctgtagtcccagctacttaggaggtgaaggtggaggcaggaggatcgcttgaggccaagagggcaagactgcagtgagccatgactaaaccactgcactccagtctaggcaacagagcaagactctatctcacaaaaaaaaaaaaaaaaaaaaaaaaaaaaattggacacagctaaaaaatcttggacacacggacacacataatataaaacacaactctgggctgggcatggtggctcacgcctgtaatcccagcactttgggaggctgaggtgggcagatcacaaggtcaggagatcgagaccatcctggctaacatggtgaaacgccatctctactaaaaaaaaaaaaatacaaaaattagctgggcatggcagtgcgtgcctgtaatcccagctacttgggaggctgaggcaggagaattgcttgaacctgggaggtggaggttgcagtgagccgagattgcatcactgtactccagcctggtgacaaagctagactctgtcaaaaacaaaaacaaaacaaaacaagacagacaaacaaacaaacaaaaaaacctctggccaggcgtggtggctcacttctttaatcccagcactctgggaagctaaggtgggcagatcacctgaggccaggagttcgagaccagcctggccaacatggcaaatcactgtctctactaaaaatacaaaaattagctggatgtggtggcaggcacctgtaatcccagctactcaggaggctgaggcatgagaatcgcttgaacccaggaggtggaggttgcagtgagccaagatcacaccactgcactccagcctgagggatagagcgagactctgtttccaaaacaaacaaacacaaagaaacaaacaaacggacaaagaaacggaaaatagctctgtgttatattatggtcaaggctgctgtcaaatatggactgggctaaacaaaaacatcataggaacaaaaaaatacacctaattctgtcatactcatcctcatatcgcagcacacagttaaatgttcagtctatatctgttagataaatgaagaactaaatgagaatgcagggttactaggaatggttgaaacaatacccataaactcaataaccacatgtagggatctactaattatttaatccactctagcaggttctctagcaacccacatccaaggtctaaacattgaaactacaacccattgttgagagaaattaaagaaggctcccaacatggagagatacatcatgttcatagattgaaaggcttaatattgttaaagatatcaatcctccctcaaatggtttatagattcaatgcaatccaatcaaaaccccagtaggctttttccccccatataaattggcaaggtattctaaaactcatgtgaaagtgtgacaaactttgaaaagacaaaacaattttgaaaatgaagaacagcattggagaactcacattacctgatttcaagacgtgttacaaagctacagtagtcaagagagtgtggcattggcatcgagatagacattgtctcagtttgcttggggtgctataacaaaataccacagactgggtggcttaaacaacagacatttatttctcacagttctggaggctaaaagtctaaagtcaaggtgccagcagatttggttcttggtaatagttctctttggcttggacacagctgccttcttgctgtatcctcacacacagtggaggaaggaagctctagtgtctcttcctcttgttgttgggaaccaatcccatcatgagggtcccaccgtcatgacctcatctaaacctaatgcgctcccagaggccccaactcctaatgccatgtgatatggtttggctgtgttcccacccaaatctcatcttgaattgtggctcccaaaatttccatgtgtcctatgagagacccagtgggaggtaattgaatcatgggggcgggtctttcctgtgctgttctcctgatagtaagtctcacaagatctgatggttttataatgggcagttcccctgcacaagttctctcttccttgccaccatgtaagatgtgactttgctcctccttgcctcccaccatgattgtgaggcctccctcaccacgtggccctgtgagtcaattaaacttctttttctttataagttacccagtctcgatatgcctttattagcagcgtgaaaatggattaatacaccatcccactgggatcagggcttccacatatgaattttcagggggcacaaatattcagttcatagtgctgactgatgaggtaccatgaagagtccagaagtagactcacacacatatggccaactgattttccacaaaggggctaaggtaactcaactggagaaaagatactcttttcaacaaatggtgctagaaaaactggatatccatatataaaaaaatgaattgtgaatttgcctcacaccacacacaaaatggatcatagacctaaatataagagctaagattatacaacttctataaggaaacaggtctatgtttttataagaaaacactggataaaggcttagtgacttgagttttgcaaagatttcttaactatgacacaaaaagcacaaactataaaatttaaaagtccataccttagactccatcaacataacacaacttctgctctttaaaatgcagtgttatgcaaatggaaaggcaagccagagtttggaagaaaaatattgcaaaatacatatctgacaaaggacttgtgtctagaactcttagaacttaagaagaagacaaacaacctcatttaaaaacgggcaaaagacttgaacagatacttcctcaaagaagacatatgaatggccaaaggacacatgaaaagatgctcaacatcattagttatcagggaaatgcaaatcaaaaccacaatgaaataccaccccacacccactgggatggctataatgaaaagacagacaataacaagtgttagtgtattagtctgttcttgcattactatgaagaaatacctgagattgggtaatttatgaagaaaagaggtttaattggctcacggtttttcaggctgtacaggaagcatggcagcatctgcttctggggaagcctcaggggtttttactcatggtggaacgcaaagcaggagcaggcacatcacgctgccagagcaggagcaagagagagaaaggggaggtgccacacgcctttaaaggaccatctcttgggagaactcaatcactatcatgaggacaacaccaagaggatggtactaaaccattcgtgagaaccctgcccccatgatccagtaacctcccaccaggccccacctccaacattggagattacaattcaacatgagatttgggtgggatcacagatccaaactatattggttggtgagcatatggagaaactaaaacgcttgtacactgctggtgggaacataagatggtgcagctgctatggaaaagcttggtagttcctcgcacagttgaacacagagttaccacatgacccaacaattccactcctagccgtatatccaagagaaatgaaaacatatgtccacgcagaaactggtacacaaatgttcacagcagctttatttgtcatggccaaaacctggtaacaacccaaatgtccatcaacaggtattcaacaggtattgtggtccacccatacaatgggatcctaccaacaataaaaaaaaatggagtactgatatgcacaaaaacacctgatgaaaaaagaattgtgctgagtgaaagaggccagacatacactgtatgagtccatttctatggaattctagaaaatgggaattaatctatagtgacagcaagccaagcagtggcggtggggatgggggacagtgaggagcaggaaagaggggttgctggaggcgcaaggccacttttgggagtggcggatcaattcactgtcttgattatgggggaggtttcatgggtgtccacacatgccaaaaaccctccaactgtacactttaaagacgtgcagtttcttgtatgcccattataccttcataatgctgtcaaagaaagattaaacaatcattgaccttcaggtctgcagcaggcctccatttcccacatgaatattccccggcggtggagaaggctctaatttggccttcctgaacacaaaaggagggcactgcgctcctctcaaaagtccaaggccttcgattaaaggtatataagaatctgcagagcagctgtccagaactcctggaggacccccgttttgtgaagacagtgatagatgcactggggctggcatcggatggaaccagctgcgagtcccatggcaagtgggagcccctgagacacgtggctggggccctggtgtcaaagacgtcccctctcatgttgcctcagcgtcatcatgcccccagcccaacacctcatgggcatcacaaccatcgagacgactacagttataaaatttgtggtggtcagtgtgtaaattcaaaccctgtggtagtcataatttatattaacttccctttgtcattcttagaataattctttcatgttttggaaaattgctcctcatcaggagactgttagagcccaaacttttgtatatggcatcccagactctccatactctggttctaactgaccctttagcccatacatgtcctactgaaacctctctgcccttctaagcttccctgaacacacctcatactttcccttcttccctgtctgtccgaacccaagcacttcccagccaaggactcccttcctttgcttctacctccacttcctgtctccagagctgcccttccaactaccctggcaagtatgggagctgccatgttgcctgaagtctgggaacagaagcgactggaaagaacacacagctgtgttctcaggagactgatgtggcactttgctgaggaacacaggggaccaggcccagcctcccttccctctggtctcagagtcacggcatctgagtggcctcgggtggctgcctgtggtcccagtcagaggagcctgcacccctgggctgacccgaggcagctcacccagaatgcctttctgtcttaccttcacagggacccccacaaggaacacccaaagcccagctctggccattccccacaatctcaggcttacagcctttcctgtaaccttgaacccaaggcctatccatgtagtttaaaccctcagaataacctctctacactagagggctcatttccaggccaatactcatacatcttccttatttgcaaccaaagtaaatgggacagttccatttcacaacgaatccagccaggacaatttactagttacatggagacactgccagagcatttatgtggctcttgaagcattcacagtttcaaagggcaaaagcccaaagacaaaggggtcccaggttggcatccaggtaagttcttcggtggcagggtggaggaagccttggaaaacaggcaagactttccccatagtttaagcttttacattctagctgtccatcacaaagcaagcttgggctataccctcccagttccccacacagcaagagggagggagcccaatttcaaggcaccattgaaggaaaaacacaaatgtccttttcgaacattctgactttgattccatgtgaaacccgttcagctcacgtggcatacctaactgccacacccaaaagaaaatgatagcaatgaccaccttgcagtgagaatgtcattatggggagctaaattagactaagcaatgataaaaggctgcactattttaaatgccatttatctaagtaagcactggggaccctggaacttttcccggcactccaaagtcacagtgcaagtgcccagcatctctcctggcaactccactttctgctgaaaactcctgtaccttgtcctgccagtatctagacagtcttgggtaggtcctgaggtgaaaaaaaaggagcttccgttaaaaacagggttcacttatgcatcagaaccaatggcatgacaagatactaaggagtcgattcttctttagtgaaagctggctactgtctggcttgtaggaacgaaatcatttacctcctagaacaacggaaatgggtatcagagtgcgtggatctgtttctttcctggttcagttgaatgaagcaagactagagcccaattgcatggcctcctgccacaggcacctactctgcacgaggattgcatttctgggcccatgccagcccttgcaaagactgtctgcacagcagaaaaacccagacttcccaatggcctcatcagggacttcaaatacaccattcctaatacttctttttctggaaaacccaaagtcgtagatgcttcggattgcctcaaggcaaggctggagccgacaatggtcccaagcctgagtctgaggtgctaggactgcaagacctatttcactcatgcttactgattaccagcaccgggcttggcatcaaggacatggggacaggcatgacacacacttgtgggcttatgagaccagcttgcagacaagaacgcaatcacaggatggggaatagggacacactgaaggaggctacggtataagtgcaacttacaagaactctagaagttttcataaaactatatatatcgtgtgtgtgtgtgtgtgtgtgtgtgtgtgtgtgtgtgtgtataacattatttctggagttgtcctagtgactggcactccaagcagcattctccgagggaatcctgtatgtttgggtcttcccacactctcctgataggagccagctgtctttgaacctcccccctccaccacgcctaccacccacctgccctcaggccttgtggatgaaaaaccccctctcccctgggaggggacagggctggaaggaggtggccgctgaccaggacgctgggctgagagcaccaaggggcagagctcctgagcccagctctggggacagcgctggggaactaggataaggcctgccagcagctgcctctgccagccctgagacttttccttgagaattccccttggctttcagtaaagtgccatttgaagagtctgccctgtttctgcagggctaaggggaagaggggtggactgcatcgttgtagggagaagaggggccaggcttgccaccacactcatctgggggcaggcctggggtggccccctttctcctgcctgaggtcttctcagagggctggggggactcttatttagggagtgaatccctgatactctgatatggcaaaatctctattttcaatatacattacccctgaatacaaaaacaatcaaagcaacggaacgtccagtattctacaaaatgtcacgcaaaagacattcgatgaaagattcgttcctgggcttgctctgttgcctaagtgcaaattcctaacccgtctggctttcctcctaatcgtcaccagccgcaagagaggctgcctgatggggaggagcaggtaagtgcgaagctttaggcactggtggtggggcggggcagggggacaggggacagagaggccagggtggcctttgctggtggggtctggggagcagaaggcagtgggcgggcaggggggaaagcaaagcctggagggtggctagctacaaatgtccaattgtgagtgacttgaagggtcttatcctctctgcagggcctgggctagccattcccagaaccactggtgctcagggatgatggggcctgggcgctgctcctcctcccagaagcagctggggccacccagacaaggcgggagttttctggcacagccccccatcctatgccaacattcagggagcctcttgcctctgtgctaactttagcgcctcccccacctgcaatataagcgcttaaaggattaaagtgctttcagtatcttctacttgggaacactaacaactcttagggcgaggggaacgacccccagggaggaaatgcaccactcttctgtaactcaaagccagcgtgccccgcgctggctggcctcactggcctcacgtggcctcctccctacccgcagcaggcgattctgatgcaaatccgagggatggttcacgcatcccctccacgcacgcctgtgcacactcgatagtacctgtggctcagggacgagtggcccaggtgccatctatgtgcctcagttgcaaggcccaggactcaggagggagtagagggcctccattcccagcccgcactgccgttgatggaggagccagggcaggcggcagtcctcggttctgagtccttcctgcgtttctcagcctcagggtgaggctctgcctggggtcttctgatggccaaagaggtcagggctgtggccgcaatcgaggccctgggagggcggtcttcccacctgaagggggctgagcctcgacgtccccaggaaggccccccacgcagaccggccgcgccctgggtgcgctggcggggagtcagcggcggctgggcctggaaggcctggcggctgtgctcggccgcggggggctggtggccgccaccgcgctcccagggccggtgctcccagggcccgctagcctccgcgccgtctccgccttcgcagggcgcctggcgccgtgcactgcctggtgcttgaataggttggcgcgccggccgaaggccttgccgcagtcgctgcactcgtagggcttctcaccgctgtgcacgcgccggtgctggctgaggcccgaacggccacggaaggccttgccgcactcgcggcacgcgaagggccgctcgccgctgtggctgcgctggtggtggatgagctgcgagacgcccttgaaggccttggcgcactggccgcaggcgtagggcttctcgccgcggtgcgtgcgctggtgctcgatgaggttggagctgcggctgaaggccttgccgcactctgggcacgcgtagggccgctcgccgctgtgcacgcgcgcgtgctccaggagcgcgaagctgcggcggaacagtttgccgcagtcgccgcaggcgaagggccgctcgccgctgtggatgacctggtgcttgatgaggttggagctgcgcgtgaaggtcttgctgcactcggggcaggcgtagggcttctcgccgctgtggatgcgctggtgctccaggagcgcgaagctgcggcgaaacagcttgccgcactcggggcacgcgtaaggcttctcgccactgtggatgatgcggtgcttgatgaggttggagctgcggctgaaggccttcccacactgctggcacaggtaccgcttctccgcgcctttggggccctgcggccccgcagccgaactctgccccaagccctgggcacctctctggagcacagacgacctcgccgcctgcccctccttgccaccttgtggatcggccccggggagttgtcgtccagaatgcttctgcgttgaagtcgacgtcttgctctgtgttctgtcacctggaaagacagagcaccaggcagtgtcaccctcatgccaagtcagagagatgaacgagcaggaggtgagaacatagggggatggggcaaggtgaccacagaacagaaagccatcacacaggcagacaggagagatgaaggggcgggaggatgggctggagatagcggggctgctgtgacacctggagattgacatctgcctccaaagaggatttcccacccaaagcggcagggtaccctcccccgccccctttgccactgctatttctttttaccccgatggggagctggttgagcacctctcactcacctatgtgcaatcctgcggtggcccaggttctggggatgtctgctacccagggtccttcccctcgttccaattgggagatcaggtgaggcttggagaaggaaaatcctgggcgtggaatatgaagcaggtcaagaccactatggctgagggcagggtcgctcctgaactcaggcaattctcaatatcttcaggtaacagagaataaagaactctctaaaaagcactactgggaaggctcagagaaagggccaagtccctctacgagggcaagggctcctgcgcgtccagggccaggtgggcacggagatcttcagtagctggcgatttgggccatgaggacaactgtgtttgtcacctggcctgcagggaggctgagaagctcatgagaaatcggggatgtgtgtgggcaccctgagggacagaagaagggcttgcaagccccagggactattgggaggccgacagccataggccccgaaagctgaattgccctgtttcatcatccaactccactgaggatcccagacccctccctggaaccccaggtctgcctggtgagtgtcagaaggaatccaggggatgaagctgctttccctctatggggctagattacagaggcaaaatctgtggagtcagactcccacaaccccaaaggcagtagagtgcaatgttgaagaccctctggatttcccctccagcggcaaggggaagtggagtgtttccatttccactgggaagtggagtgtctgagcttagctgcagcagccagccttgctgggcacactgggggaaaagccagaggcccagtcccactctgtttcacgcatgcatctctcatcagctgcgtgaggtgggggcaagtcactggcaccctcagacgttctttaccccacctgaaaaccttcctgagtgctccggcccccatccgtctagcctgtgactcctgcttttgccctttaattggcaaaattgctgccccttccggcagtgggtgtgcactggcatggaagggggagagcagtgtgctccaagctgccccagctcctcccgggacttctcaaggcttgaaatccaagtctacactttgtccttatgtgggacctccctggtcaatggaaggaaaagatgttgctaaattttacaaagtggaacggatgcaaaatgcagccgtcatagaaacgaattaagtctaaaagagtgcacataaatattccagtagaatttgcatctctcttttgagtagaaagacctttagtcgatccacgattttatacacaagataagactggtactgaaacttacaggccaacgcatttacctaaaacatttacaggtccagaccacttagctaaaaaccatcctactgagatggcggctggcctgcaatggattactggcattactggtctgatggagaaatgcatttattcttgggctcatagcaaccgacaaacaggaatctcggaaataaactgagcccagagacagagtaggtgggactgggtgtgtgtatgtcgtggagggatcacttacccagtgacaccaaatggctatagttctccagcatcacccgcttgtagaggaccttttgtctgaggtccagaagcttccattctgtctttgtgaagtacacggacacatcctcaaaagatactggcacctaaaataaggcattcttgtggccacaggggaattcaaccccctgggcccctggaggagctgacagaaacaaaatgtggggggcggggggagccctggaaggctcagcaggtggaaagactcgggttgcacgagttgtaagacagaaaaacaggcagcacagccgacagaggcaggaagcccagattgtgcgcctcaggaaaggaaaacgatgctaagggcagcctaagctcagcccagctggagaggcctgggcatgaggaggcagcagacgggggctgccagggggagaggccagggagaggggccaccactcaccttgggtctcgtggtcaggagaatggctgccatcaccagggcgcagaggagctaagggaaatgcaaagagccccctgtgagcccagggcagcctggagcagccaatctgcgacctgcttgaagaccctgcttagtttttcttgtgaaataagcacagcggccacctgtggtgttctcactcctgcagcttcaccaagggcccctcaccatcagaccttctgtatggcttcctggggcggccataataagtactacaaatcggggccttcaagcaagacacatttttctctcccggttctggaggccagaagtccgagatccaggtgctggcaggcccccgctccactgaagcccctttctcgccattttcggcttctggtggtttccagcaatccttcttggcctctgtcttcgtgtggccatcctctctctgtgtgtgtctgtgtcccaatttccctggtctgttgtgaatgccaatcactggattagggcccaccctgctcctacagtatgacctcatcttaccttgattacagctgcaaagtctccctttccaaatgaggtcacagtcacagataccaggagttgagacttcaatatgtctttttggggggcaccattcaaacccaggacactctctgcaattgaggtgccatgcccacttccatactggcgctcgcctgaccaggctttcgagggagcccgttccttctttcctttcttttcttcttttgctgcttttcttagctctctccccatgtggccagcgtcccctgaccccaactttccagccattcctggaagctccactgccaatccccttccctcaggtcgggattcttaaggaaactccaaatgcacatgtacgacctccctttgcaaaatgaagagaagagaggtgagggcagtgcagaatcaagggggacctacagtagtgggggtgctctctgaaggggtgacattcaggcagagagctggaggctgcaagtggcaaagagagtagccagccaacagcacagcacataccctggccctcagatggtcctgcatttggcattcgtggtgctgaaaattagggaacaggcgcagaggatgacaccacgtgggaccctggagggacagcaggaagttgagtttcaggctaagagtagggaacatgaaattgacaaagtggacaaaattcacctcggcctcaggacttctccacagcagttctcaatgccagatggcagtcagtgctgtgggttggatatctgagtctccacacgtcacgttgcaatttgatccccagtgttggaggtggggcctcatgggagttgtttgggtcgtgggggtgagtccctcatgaacagattaatgccctccctcaggggtgagtgagtccttgctctgtgagagctgattgttaaaaagagcctggctcctcccctcatcttgcgtcccctctggccacgtgatctctgcacatgccgtgcgccaccagctccccttagactcccaccctgaatggaagcagcttgaggctctcactagatgcagacgcccagtcttgaactttccagccagcaaaatcctgagctaaagcaaccttttctctttataaattacccagcctctggtattcctgtacagcaacacaggaggactaggacaggggggtaaaagattgttcctttctcagcacacgcccccaccagctacttcctggtttctctgcttctctgcctgggatttccattttgttggtctccaagcttttattgatgttccaatgggtgactacagtttgtttgtgccaacaacgccacaggagagagggagagggcacaggatcccaggagcatagagaaggacagccacagtatttgcctggcatttaaattgctccaaagtcccttatcatccatgatgacctgccagccaacattggtccaagatacataagctgatgttctgaatccctgaaggtggaatggatgctaaaccattaggttaaagacttgagagagaaaggggtatcacatatcaaaatgccatcctgtgattatttgagggctgcaagagagtaatctaacctagcagtgggacatagggtgggacagtcctgctgccaggatgcagtaggaaggtatcctaccaaagccatatgactggatttgaacgcagccttggcactcaatgtccagtgtccagaggcccttgggaatagatgacaccacaaggaagcaacctgcctgacccagaaaggggctgttccatagagcaacgggtcccgtatcctctgcaaatcagtgtcatggggggagaaaggagactggggagagaggctgttctagatgaaaagagatttacggggtccaacacccaactgcaagaggggtcgtcaatgagatgctggcgtaaatgagagagtcgtcaaagggattagggatcattgggagagggtgattatggggtggccctcggaaggaagtaggggatcataactgctcatgtgttggatggatagtggcactgggtcatggaagaaaatgtcccttttaaagaaatgcatattgaagcatttgggggagggaatggcatgcaacttactttaaaacctttcacaaagagaaagagagaaaagctgacacaaaaaaggcaagatggtgattaaaaagaaaaaaaaactatggaaaacagactggtggcttgtcaatgagttagacatagttatcatatgacccggcaattccacttctgggtatatacccccaaagaattgaaaacaggtggttcacacaaacccttgcgcacctgtgttcacagcagcattaatcactagagccgaaaggtggaagaagcccaaatgtccatcgatggatggatggaccaacaccatgagcctatatatacaatggaaaagtatttggccatagaaagaaaggaaattctgacacatgctaccatgtggatgaaccctgaggacactgctcagtgaaagaagccagatgcagacttgaaaggtcacatattgtatgattccattttgtgatgtaacatcacatttcccaagagccgtcttgacctagttttgaaatagtggctaaaacctctcatctctatgcccttcgagggcagtttgctaagtccccactcccaccacttttcttacaatttccctctctctggggccaccaaacacacactccaacggcccctgcctcattgggcccccacactctggggccaggcaccagacaagtagggacagcccctatgtcctggagcctgaaaacttatgcaactcaatcaatccaaaggaagctggagaaacctagccacccgcctctgctggccccttccggccccagctgctgtttcccggtccccgggtctaacctctgtgtggccctgcctggcagccttctctcgttcagagctatacagaacaaaaagctgtgcctttcatctatcccagggtcctgtcatccaaagaacctttaactctcataaaacatgtctgtccagaacaggtaaatccatcatgtcagaaggcagattggtgggtgcccgggggtggggggatggggagtgagtgctaatgggtctagaggtttccttatggggcgatgagaatgttctggagccaggtagaggtggtgactgcacaacatggtgaatgtactaaatggcctctgaattgttctctttaaaatggttaatttggccgggcgtggtggctcacacctataatcccagcactttgggaggccgaggtgggtggatcacttgagctcaggagttggagaccagcctggccaacatagtgagatcccatctctacaaaaaatacataaaattagctgggtgtggtggcgcgtgtctgtagtcccagatacttgggaggctgaggtggggtgatggcttgaactgggaaggttgaggttgcagcgagccgtgattgcaccactgcactccagcctgggcgacaaagctagactctgtctcaaaaaattaatttttatgttgtgtgaatctcacctcaatcaaaaaggagggaaaagaaatgttcctgtaggtaaaatcattctaatgtccgcaggccacacctcatttcattataacacactgtcagtcactgggacccctgcaaaactaaaggtgcgtggggaggtattactgataatttgccagtgctttcagactagtataaaattattgttttgaaaagcagcataagctcatttttttccttaccataacagtactgaaagttcactacccattttggacaagttgaaagggggaggagttatctctagtccctccaccccaagattactgaggcaggtctgagccccaagggagcagagcactgttgagtggtgaccccctgagtgaacaccccatcggcgggaggccgcccagagacggagacccgcactcaagtgcagcatcggaagacccagcggaggtgctggccacaccaagccgtcacccagagcagtgcctgtccttgagagctagttcccgaaaatcatctacaatttcaactcctggaaagaaagacacgacaaaccctgtgcccatagaactcaaataacacccaggtgggcactactccgtgcatctgaggacagaagcacctggaaggcacctggcggaactagagagcagcttcttccagctggaccagcaagaccctgtgacctttggggaccagcagagcagaggccaagcagaaggataatcctgggctctgaagccaggcttccccgaggcacagcatcgggcacacaggtgagaatccaccagaccttggcgcctcaggtgaggagccagaaaggcccatcaacctgggtgaccggtgccactgccggcccctccagggctgctccacctctgtgaggggcctcggacccgggacccctgcttgcggaccttagcctatgggtggaactgagtatgcagggtgctccacgcggggagggctgggaaggggatgagagcagggccactgccagcaaggaagcctggccaaccaaggggagagctggctctagcaggatgccttaagacgaccactagatggggagatattcccagaaaaagaaaaaagaacccacacaaacaaacaacaatcagaaaagcatccagcagtcccactcggtgggagcaggaatttgggctttttcatccacagcaagggacaggcatcaccactttggttgggtttcttccgtcctgggggatcttgcttctctcagccccatcagctttccttggcccgaggccctagtcacctgctgcccacctggcagaacggctggagaaggaaactggagaaacccagagccaaggcccggcctgggtgctgcatgggtcgaccggggccctccatgcagcctagcctgaaaaagtcctctgaggagcttccttgcagctgggcaggccttgccctctgggggcagagggtaacctagccaaaagggggccacccaggctgctcgctgagggatccttctaacaggcgggtcgggtcctgtccttctctgctcacagttatccctgggatgcccgtgtcactcagagtaaactcacacaacccttcctgaccttgcccaaccctcctcccacctctgcacctccctctgctcctgccacactcttgctcccttgagccaggccacccctgcctcagggcctttgtacaggggattccttgtgcctagaatgctcttccaaaaccataaccacatgcctcgctcttttaccaccttcaagttttggtagaaatgagacttattctagaataagttattctaaccacctaaactggcaaccagacctcccttccccggctcttactgccttttaacagactctgtaattactaatggaaaacattttctgcttattgtctgcgctcagccactagaacgagaacaacagggcagggcttactaccgccgtgtccctggcagatctcaaatgcttgctcaggaggtatctgtgggagtgaatcagtcacaactagccctgtagggaagcgctgggtgccgctttctgcccagctcagctggctccttctctcacccttgcccaccacttccatcggcccttcgcttcctccttggcttggctaagctgatgcttttccgtggcatgccagtcacctggtcaacatcccgcaccaccgcgaggcaccagcccccacctgataccctctggagcacaattttgggcatcctgccccgatctggagaccctcagggccggtgcctgggcagcggtgccacaacctcacaatgccagtctgcccagcactctcacacccagaggtgcaaaatccaaactcaccaggcagatcagcgacaggatgctctttagccagcctcgggaccggtggctggaaaccaatcaggagagaaattgacagacacgggccgcagctcccagcgcccagccctggatggctcttcccctggcgcccctggtacggggcggccccgagggctggtccggccactcagtgctagcccgcctcccagggagtccctgcttgtcgccgccgccgcagctccctcgtccccctcgacacctgcaccctgccgagacgggccccttacccgcttacccgcacccctgcggcccagctcggccctcttacctgggctcggcgggcagccgagggagtcggcctcccttcctgctcccggcaggcccgaggccaaggccgccgcctcctcctagaagccctccgaggccgcgtccccaggaaacgcgggcggggggtgggggctcctgggcttgtctcgacttcgcctctgggtaccgctcgcgaagagcgtcctgaaggggagtctcagtctggtgcgccgacgagcgggccgggagcgggcggggccggggcggcggcagcgtgggaacggggcgcgttgtggggggggcatggagcatgcgcggcgcagagggatggcggcccgccccgcgcccgccccacaggggcgtctggcctggctccccacgcgccccgaggcacttccgctttctgtctgggctgctctgaaggctggggtcgaagtggtcagcgcaccgcggctcctgaaggggacgggagggacccgcgttggcagaacacctcccatgggctagacccctgggcgttattacgtccattcattcagttattcatctcgctggggtccccgggacctctgcagggcagctagcaccaagtaccccggccatggtcactcagtaaaggagtgacccaggatggcaaggatcagagagcggggaagaggtgaaaggtgactcagggagcatggtgtggagacacgaggaggggaaaaaggaggtcagggaagtgcaagaagccaagaccctctgggtgcatctggctttccctcaggttaccggaggggatcgcacctggagtttgtcattttccaaagggtcatgctccacgtggtagagcagggagtgaaatccaaggttggttgggatattgctctgatgacaattgtgagacctttgacaaatagtgaagcgtatgaaaaagaccgtaaaagaaaagcaacagggaaaaatcagccacatcacatatcccagccccggccactgggaactgagcacgaggcgggagcctccttggcctttgaaccagagttcaggggtttcttttcttcagagaccctgggccctggccaggagcacttagcccgcagcaaggagccctcggcaagcctgcgctcccagaacaaaagccgtccatctggggcataggggaagggcgaggacgctgctcagggaacctccggttgcagggagcagggcccccagggggcccagtgcagggagagcttcggagcccctttcccggcgcagaggcagggagtctcccggtggccctcagctgtgtgtcctggtgcccaagcttgtcccttcaccggggctctggctgggcaggctgggatctgggctgttgagatgttgtggggtgactggttggtgccccttgaaagatacatccatatcttaacacccaggcactgtgatcagggccttatatgcaaataaagggtgtctgcagatgtcattaaattgaggatgtggagatgagagcaacccagatgatccagggggccccaaatccaaggacagtttccttagaagagacaggagagagagacacagagaaggccatgtggaggcgaaggtggggagtgcccagggcccccagaagctggaagaggtgggtggatccacccccagagccaccggaggaagcgcccgattctggactccggcctccagaactgggagagtcaattcctgttggctgaagccaagcggtttgtggtcatttgctgcggcagcccaggccactccgacacgagggaataggctgagcccagagtcctcctgggccatggaggcagggggcggggggacctttgcacccgcatcatccagtaacctggtggggactggggcgaccttgggaaggcagctcctgttgtccttggctcatttccagagagtgtgagcggccaacctgcatggaggctggggagtgtgtgcctcgggcaggggaagggggcccctgggagtgcaccccacttccactgcaagagaaagggccatgtgcactgggctgcgggtcccacacaagcttagaaatgggggagcaggggtcaccgtgtgcaccattgttggcaccgcgtgtgtggacacattggtggtggaggcggcagcgcggtcagctgaagagcgcgacgcctagagcaagtgaagacgaccttgacaagcccacgatcctgtcgggagatcaatctcccttccagcatgttttcagttttttactgtaaagaactgcaaacccatgcccaacctagagaggatgacagggcacacgggccctcccggcggtcctcacacggccctctctcctcctctccactccccttattgtggccctgaggcctggggcctcctgagagaggtatctccatctctgctttaggcaggggcagggcctcccgggcagcaaacccggattcagaacctggggaggaagagttggggtctggaagtggggaggtcccctttcctccctgggttcccaccacacctagccctctcacagtccggctggcctggctgctccccagctctggtctcccgttctccccttgccctaggctggcccaggacgggcaggtgaggtagccggggggcaggggagtgggcgctttcccacagctgtggtgctgcccactgtgccgtgggcacccgccaggtcacaggcagccccctcctgggggcaggttggcagccggtctcccaagccacagcaggtgcccaggggcccagcagggaggtccagggtgacgtcaagctgtctgtgggaagtgagtgagcaagttggggaaggccaggccaaagggggctgtaagccaccttcacagcagggcaggggtcagggcggcacctctcccaggggtcagctgggctgtggctgactgctctgctggagtgcccttggagggaggtggtcttgggctgcatgcagagccttgggaatatgctgccagcctcagatatccactgagggtgatggcgactgtgagctcctgtggggacaggatgtgtgtctggactggatgagctgtttttgcaactcctgcctccgcccccctgccagaaaagtgctgtagatggggtgcagccagtgagtgggggaggggatgtccaggctgcagtcccaggagacagtggctctggggaaagcaggggatggaatgcacgcggcaatgcctcaggtcacgcaggttgctccttgaccctgcagaagggtcggagtactgcgtggctcatggcatggagaatgccttgtgtcatgtgggccagtttgtccaaccctgcgacccctgaggattgatgggaccctcaggatgaggccggtaggggcaatagtgtcaggcctgggtgccaggagggagcaatgcccaggcctcagggcaggctgtcttggccttcagaagcctgaggccctgaagctcagctgggcacctgccccaggaggtggccgtccactgcctgagtggcagcttctctcatggctgcagctgtggctccggttcctgaatgtcccagaggggagccaccactggccctctgctgatcctcttcagtgtggccactgccgttctcactgtccctcccaggacggcctccctctcccttcactgactctcccagtctgatcacaactgtttctcaactatccctcccagtgtggccacagctatccttatggtgccccctccagtggcttcactgtcctgagctgtcacccaggccccagcctctttccaacctcaagtcttggctctggcttcaggctgctgcctgtgtgctagagaatgtctgtcagtgtccgctgggatcacgtgcttccttgttcctgctcaaggaaagagaggcccctcctctgtggataaaatctgaaaacttccctttggtctgactgggccatttgggccatggactgctcggatcactaacagttgccccaggaacacatgtgcagctgcatttgaaccaatcaggagccacctgtggatttggggatgggagtcaccatgccctgagccacgtgggggagggacggaggctggaacaaaaaggggcttctagccgggcatggtggctcatgcctgtaatctcaccactttgggaggctgaggcaggaggactgcttgagatcaggagtttgagatcagcctgggcaacacggtgagaccccatctctacaaaacataaaaaagttttggctgggcacagtggcatgcacctgtagtccaagctacttgggaagctgaagtgggaggatcactggaacccaggagtttgaggctgcagtgagctattatggccccactgcactccagcctgggcagcagagcgagaccccgactctaaaacaagcaggagtccactgaggaaaaaagagggggaatggctgctgggagggcagccagcagtgtctagtctccagacattccttcaggtgatagggaccaaagccaggagggtcaccaagggtaaggagctgaagagtcacccagccttgccaagacttcctggcagaggagaaggcttagccatctactggcccggaggctgagctggagcgtggctgtgcctggcctcttggctggcctccccagcctcagtgcctggcatgtccccacctggatgcacctgcttttttggtatttgcacttggatgcgccaatgcacacatccaaaactgagcttgtgatctcgtgccagggctagcgctcttaccaagtccccagctgcagtgaatggaacacgcctgtgtcaaaggccagaaagtggggatacatcccttgcccaccctccacctcccatcattcacggtgtctggttagttctctgcacgttttaggtctgttaaacggaccctctctatctgctccatgacactgtccttgatgtcatctaggctagttatctctcacaggacaactccagccacccttagctagtcttactgcatccactctggtccccaaataatttctccacaaagaaaccagagataactctttagaatgcaatgagttcgtgtcactcacacaaatacatgtctgtgcgtgcatgtgcagcactggcttcacatctgtcagtgagttctcagctttttcaggatgaagatgaaacccctctgaggtccatgaggtctgcactgtctggcctccgcagcattggtgcgtggcatccccaaccctgcagtcacaccgacctttcagcccagtactctccatgtcccttccagctccaggacctttgcacatgcaattctctcacctgatggggagcttccctcccaaaagaggagtggaaaatgtctgggctttcccagcttcccttgtagctatggcatgggcacctaacccaggctctaccaatcagatacacccactacccactgagtgtgaggcccgaggtacgcctgtgggataccctctagctggttttccctgggcttccatcagccagtctgttcctgttatgtgcaactgagaaccctgagggactagctctccgccgatgccgtcgaatctcccgctgctttaaatgctcccctccccgggctcaggatgccactggcccttggtttgcttctcagaacttgagcagctctctgcagagtccttttttgactcttcttacttcatctttcctctaagattggtgtctgttcatggttatgaatatttagaggcttcatattacttgcgggattgatggcccaccaggcaatgcctccctgggtgacttttggtgccatttactaagacaatgctgctcagaagagtaggcttggaggaaatctcaccggccactgtagactgctgggcattaaggggatattagagtattagttatctattgttacataacaaattactcccaatggcttagctgaggggttctgggttagggtcactcatgaggcaacagtgaaactttcatccagggcagcagcctctgagacttaattggggctgagggatccacttccaggcttactcacgtggctacatggctgttggcaagtagctcagttcctcagcacgtgggcctctccatagggctgctcatagcagggcttcctgcaaaacagtgatctattttggggggtgagggagagagagagagtgagagaggcagggggatctatgtgtgtgtggggagacagagtgaagggtggggaaagggagagggagggaggaaagggcgggggaggaaaggagaaaggggaaacaagtgcaagaaggtaagagagagcacccaagacacacgctgccttctctgagaagccacgcttgccagttacagcccacagattctgctgaactctttgttactaagtctagactccactcaaagggagagggatccagctacacctcttgaaaggggagtatcacagagtttgtggacgtattcttcaaatcctctttttagtcacctatgataactgcatcaggtcccatgaatgagaggatgggttggagaggcgacaacacttgaagcaaagtgggggttagagccttagttatctatcactacataacaaattactcctggtggcttagctgggaggttccggcttagggtcactcacaaggcgacagcgaaactgtcatccggggcatcttgttaaaacttgccatagtgttggccccagggatcttgttaaaacttaagtcaggttctgccttcggcaatggtggagtcactcctatcagaccaaccctcccacagatgacatctatgaaaccaggatgaaatactaacaacaaaaccttctgatggcatgagggactaagcagtagaggcagaaaccatagggggttaacacctcgaagaagagactggcactaggtgagtttcttacatgtgagcatgggccacagaggacaccgtgctgggtgaccaaaactcagagactcagagagtagactttgggatggccacgggagagggaaagcatgaggggtatcacctgggagcagagaagcaccatgtggaggagccccgtatttggcctgtacacttggcccaaatctctggctgaccccagggctattaatacacaaggcagagtccaagaaaagaactgagcagaggtttcagctgatgcccaataccgtggaaacggagtctggagattgcagttgatacccaacacaggggagacttagtgtgagtttagctagtttagttgtctactaggacaacaaaccaccaccgccaccaccaccaccaccacaacaacaataacaaacaatgactcatcttcggagaaatataacagaaaccaagaagccaaagctactagaactcattatggacagtgtctaggatataatgctagattactacaagaaacaagaattgtcctgatactcaaggaaaaaagcattcaagagaatccaacctctgagatgaccctagtaattcacaatattaaaaaaatatatattcttaaggagataaagcacacttctgcctgtaatcccagcactttgggaggctgaggtgggtggattgcttgagcctaggagtttgaggccagcctgggcaatatggtgaaactctgtctttacaaaacatacaaaaaatttagctgggcattgtgacgtgcacctgtagtcccagctacttgggaggctgaggtgggaggattgcttgagcctgggaggtggaggttgcaatgagccataatcacaccattgcactccagcctaggcaacagagtgacactgtgtaaaaaaaaaaaaaaaaagaagcatgcttctaatactttattaatttatttattttgaggcagagttttgctctgttactcaggctggagtgcagtggtgtgatcatggctcactgcaacctccacctcccaggctcaagcaatcctcccatctcagcctcccaggtagctgggattacaggcatgtgccaccacatccagctaatttttgtatttttttgtagagatggggtttctccatgttgcccaggctgatctcaaactcctgacctcaagcaatctgctcacttcagcctcccaaagtgctgggattacaggtgtgagccaccatgcccagccacctaacatttttttttaaacccatctcactgctcactgattatgaattttttcaaataggaaatttcagaagagaaatagaaactatagatgttccttgacttactgtggttaagtcctgacaaaccagtagtaagtcaaaaatatggtaatttgaaaatgcatttaatgtcccgataaacccagatgctccttgacttaggttggggtgatgtcccagtaaagccagtgtaaagttgaaaaatcataagtcaaaccgtcataaatcaaggactgtgtaagttgcaagtgtaagtaaagaaccaagggtaagttctgaactgaaaaacaacattggaagtaaaatcttcactggatgatcttaataacattgtagatgacaggtgagttgcaaacttacagataaatagaaataatcttttctgaaaaaccaagaggaaaaaatgaaaagggcgcctcagtgagctgtgggacaatatatagaggtctaatgaatgtgtatatggactcctaggagagaagggagagaatggggaagaaaaactactcgaagaaataatgactgaaatttccaaaatttggagatagacataatttacagattcaaggagctcagtgaattccaaggaagataaatacaaagaaaaaacacgtgtaggcacattgcagtcaaagtaccgaaaacaaagagtaatgagtgaattgtgaaaacagtaaaatgcaactcgaagaagaagagaacattcacaagttctactgaattctcatcagaagtaatggaaaccaagagagaatggaacaggatctttaaagtggtgagagagaagaaacaatcctttcaactcagaactctgtatctatatccagggaaaatactcctaagaatgaaggtgaaataaggatgtttcgagatacatgaaagctaagagaattcatcaacagacttgcattaaaataaatgctacagaaagactttcgatcttaaggaaaagaaggaaatctcgatctttgggtagaaatgaataacaaaatatgtgggtaaatatcaaggaatatttattttatctttataagttatttataatacacatgacagtttaaggtaaaattataaataatgtattatagggtttataacatgtagatatatatatgacaactatagcataaaggacggggtgcagggggcagtaatctgtataatgaaaatggtcttaaatttaggtgatgtggtacaatgtaaactgtaagtagagagtgaaaagtaaaggatatatataggaatccctagagcaaccactagaaaacaatgcaaaatgttattgctgaaaaggtaaaataaaaggtaataatgatacaaggatcaattaatcaggaacacatcgaattcatacatatgtttgcacccaataacagagcttcagagcttcaaaatacataaaacaaaagttgacagaataaagacagaaatcggcatcttcacaattataattggagattttaacactcctgccccagtcattgttactgctagaaaagggatcaataaaaacatagggcctgtaatcccagcactttgggaggccgaggcgggcggatcacaaggtcaagagatggagaccatcctggtcaacatggtgaaaccccgtctctactaaaaataccaaaattagctgggcgtggtagtgcgcacctgtagtcccagctactcgggaggctgaggcaggagaatcgcttgtacccgggaggcggaggttgcagtgagccgaaattgcgccactgcagcctggcaacagagcgagtctcaaaaaaaaaaaaaaaaaaaatccagcctggcgacagaacaagactcagtctaaaaaaacaaaaacaaaaacaaaacaaaacaaaaaccaaataaacaaaaaacaaaacaaaacaaaacaaaacataggatctttttatgacattaccaagcacattggaaagcaaacagtggaaaaaattggaccgatttaccgcaatgaactttcgctttgcaaatgtactccgccgatcctcgtgggcaggcctttccattggcggagggtcaatcggtgtgcctgccgcttctgggcttcgagcctttccaccttttgattcacgtgtagtcgtcatggtaacaacagtgcattcccacgtgctcctctcttgtgctctccctatccaatcatttgccttgcatagcgacaccagtctggaactttctttcggaactccctgtggcttccgggagaaccaggggtttctgggagcccgggtgactgttggcgccaagtgcctcagagagccacacgcttccacgctgcggagctgaggtgatctcttcagacccttcggagagacccagatatctgacttcccactgagagacccggaattgcccagagtttgagaaagtgagtagaccgcgggggtttgccaggacccaggcccaggaggtgttgccggagctcaggatggcggcccaggaggttcccggggtgtggggggggggcaggcggtgtggcaggccgtgaggagccggctgcggagctggggggcggcggtcccgcctggcccggtttaggtgcggcgtggctgtcacggtgggcttcccgccaaggaaggccccctcgggagggcggttggaaggagggctgaggggaggggttcctcagtgcggggtggccagaggaggacccctgggtccctgggcggagagggtcgccaagcacgcggggtagaagaggcaagagggagggtgactcgcccagtgctggggtgagggggtgtcgagggcttccggctgtggggctgggggtcgggagggggctccctggggtgggagggcaagggggctgtggagcgccacgtgggagagcaggctggcgggctccaagcgtggggcgggacggagggcggcccagcctgggtctgaggcgcgagaggggacggcccctggcgggtgccgtggtcaggtcctagggctgggtgggtgagggcagaggtgattcctaagcccggtggagggccgaccagagcggagggtgccctgcctctgtgggctatgggggctcctgacttgggggtggagggcgggattgtcgggcccctggctgtggggaggccacagagggaggctcatgtctaagcacgtgggacgccctgctgcccggggctagactggagtgctgccagctgggtttagggggcgcccagtgtggaagggcacgttgggggcaggaagggactgtccccggtgtgcggtgggggatgggctggaaggagggccaatgcctaagggtgcacggggtgcggagccggaggctgcctggcggccagtggtacaggcgacggtgagcgccccctggaggctgtcggcgtggcagtgccgtgaggagcctggccccctacaggtggaattggaaaggcttcaggtcgcctcttcgtggggaatggcgacaggagttgcagtggttggagggggcagaccttggcctctgtagaaaatacggattcatgacaagggcaaattgtacattcacttagatagaccatatgtcgagccatttaaaaatcttcagaaactgaaaaggatcgcacgttttcataagttctctgatcacagtggaattttatttgaaattaataacaataacatatgtctagatattttgaaatccatgggtcaaagatgaaatcaccaaggaacttacaagatatttcaaactgcacaaaacattcaacttacccaaattactagccatttggaaggaaggaagtggtcagaggaaaatttcttgctttcagtgctcataacagaaaaaaagaacataaaatcaatggccgaacagtccatttaaagaagctcgaaaaagagcaaaagtaaacacagaatgagtcaaataaagaaataacagagataaaaaggacaatcagtaaaccccgatattaggctttttaaagagtaccaaaattaatgaaccctagcaagactaattaagatgagagggggctaggcacagtggtttatgcctgtaatcccagcactttgagaggctgaggcgggaggattgcctgagcccaggagttcaaggccagcctaggcaacatagtgagaccccttctctacaaaaagtacaaaaaatttaaccacgtgtgttagcatgtgccggtagtcccagctactcaggaggctgaggtgggaggatcgcttgagctcagggggtcgaggctgcactgagccgagatcaagctgctgcactccagcctgggtgacagagtgagaccctgtctcaaaaaacaaacaaacaaacaaaaaacaacacacacacacacacacacacacacaacacacaagagagaatgaacactaatcaatatcaggaatgaaggacaggatattactacagatcatatagacattaaaaagataaagagggaatattgtgaacaagtttttatcaaaagttttgaaaactgagataagcttcccaattcctttgtgggggaaaaaaagtaacttactacaaatggcaccaagtagcatagaaaatgtgactagccctgtatcttgcaaataaatttaattttgccatcaaaatttcactaaaatcaaagcgacaaaacaaggaggcagaggaactccagccctgccccctcacccccacacacgtaggggcagatgagtggtgggagtgagtgtttggcacaaacaagcttctctctttgcactcacaggctgtgtcggagactgcaacagtcagcacacattcctgattgatcaggctccctccctcaagtcctctgcgatggctctggcgatgcttcgggactggtgcaggtggatgggtgcgaacgcagagcgctccctgctcatcctgggtatccctgatgactgcaaggaacatgagttccaggaggccgtgcgggctgccctgtcgcccctgggcaggtaccgagtactcaccaagcacttcagaaaggagctcggggccaaggcagccttggtggagttcgctgagtatttaaaccgaagcttgattccccatcaaataccaggcaatggggggccctggaaagtgatcttcctgccccaagtacctgttattgagtttcaggatatgcccagttttcctgcacagccccagggtcaagcagtagcaaaagctgcaggtgagggaggaggcgcaggtgaggcaggaggtgtaggtgaggtaggagcagcaggtgaggcaggaggcacaggtgaggcaggagcaacaggtgaggcaggagcagcaggtgaggcaggaggcgcaggtgaggcaggaggtgtaggtgaggcaggagcagcaggtgaggcaggaggcgcaggtgaggcaggagcagcaggtgagggaggagcagcaggtgaggcaggaggcgcaggtgaggcaggaggtgtaggtgaggcaggagcagcaggtgaggcaggaggcgcaggtgaggcaggaggtgtaggtgaggcaggagcagcaggtgaggcaggaggcgcaggtgaggcaggagcagcaggtgaggcaggaggcgcaggtgagggaagagcagcaggtgaggcaggagcagcaggtgaggcaggagctgtgggtgaggcaggagcagcaggtgaggcaggagctgtgggtgaggcaggagctgcaggtgaggcaggagctgtgggtgaagcaggagggacaaatgtaacaaaagcctgggtccagccttggcgctgcaccctacagcctgtgctggaaaacagggcctaccgggaattgagacccttttccaggagggagcagccaggctgcgaggaagagtcctttgagagctgggtggagcatgccaaggatatgctgcagctgtggtgccatgcgtcggaaagggagaagaagaggtggctgctggagagcttgggcggcccggccctggaagtcgtgagcggcctcctggaggaagataccaacttgtccgcgctggactgcctggcggcgctggggcaggtatttaggaaccaggacactcgaatgacttcgaggctgaagttcctgacctgcacgcaggggccccaggaggggctgtttgccttcgtggtgcgcctggaaggcctgctgcagagggctgtggagaagggggccgtctgcccagccttggccaattacctgcgactacagcaggtgctgtcttgggcccgccccagcgaggcactccaggataccctgagagggatgcagctggagaagaggccacctggcttcctggggctgctccggctcatccgggagatggaggcatgggcagccttcccagcgaggagccagcagggtgtggcctgggcagcggccccagtggagagtgaagacccagctgctgcccaggcctccccagcccaggggaatgccagcgaggctggtcccggagcagaagatgctgccgaggccgcttctgccaccaaagaggctgcaaggggagcccctgccgctggggaaggtgaaagtgcccctgcaggccccgaaggcctaggtcaggcaaggcccatagaggtcccctggggctcctccccagcccggatgagcagtgctgtctgggtgttcccaagaggtcttagctggggtccagagggcctcatccaggtgagaggccaggaagccaggaaacccccactggaggggctccagaccatcttggaggagccggaaaacgaggatgaggatggggccggggacgagggccagcccaagtcctcccagggcaaataggctcctagggccccggggcctcctctcctctcaggcagcagcgccttggaggcagacagaggccaggccagggccagtccctcaccccacattcaggagtaagggccccccacctcccccaaggggctctggccaccacccccattccttccctgtgacccggatgaccacgtttgatacaaaatggggtggggagaggcgcccccccgctcccttgcacccagcacacccagccccagccccaaaccctgccgccacggggggctggcctggagggagccctgagtgggcagctgtggcctgggtgggggcacctgaagatgtctgcccccaacccaggccgtgagttgggagagacagggggaaagaggccctctcaaggttgccagctgcctgggtctctcaagaggggtcagcccacttgccatctccggggcaggctgccctctgttccgggaagctcaccctcacctgtgtgacccacgcgcccagcagacgcccacccactgctagccatcatttctgcgaaaagtcatgtactgtgcgcccatgcaggcggccacctctgggcccggggcacgtgctgtgagcttcctgcgagcccaggctctgcttgctgctgtcctgcatcgtgagcaccacctctgctttcctggcgtagatctaggccaggggctgcttgttctcgtggagctgcgtgtgttcttctctgagcagcctctccccggagacccccagcgcagtcccaggagatggcgggaaggaggcaccagggcacggcggacgctcaccccgtgaccacgatggtgaccctgactgcgggaagaagaaccggacccggggcacagcggggctgcgtgaggatccacaagaactatgctttggcgtttcacccctgttgttacttgtgactcagtttcttcagcctggtggggtgttccctggtgtttcccagtgttctgtgactgtcctgtgaaggccatagggatgggctcaggagggggctccctgaagccagtggacactgccagagtccactgtcctggcaaaaggcagaccctggggccctcgggaaggagggaggtggcagcgggggcagcagcgggagggggagcagatgacgtgccttgccaggaaccccaggaggagggggcctgggacctgtgtcctgtggtggctgtttacagtttctctctgtattgtggtttccttctcttcaatagtttcagtatatgtttctcttcaataaatttcattccgtgttccagccggtctcgcctctgctgtgggaaactaggggagggggattggctggggatggggtgggcatggaggagaggaaaaatattcctgcccagcacccctgggggacatctccaaaaagagtgtaagtgagagcactttgaccagcatgcgagggcacgacaagggcttttcttatattttataggtgaattgtcaagttttggggtttcattcgtccttagattgtgttgtcctgttccctgcagcttttaaaaatgtgtgggaatgatgctggttgtttactcgatttgggggaaggtgccactggcattccgtcctcagggttcaggacttctgaacgtgggtcacgtgtttctgaggccatgcaagaaagatcagtcctgcccacaaggtcaatagcacccacaatgagaaagccagtattagagttacaggggtttcctaaaacccccaaatgttttaaaacttgagatatcctaaaacttgaaaatgtcactatggaacaataatgagcaacttcaaatctctagagcctagtggggcttccgggaggatgggtgcaaacattcatccgatctccacctgagacgggagatgtgctatccaggaagaggagaggcaaggcaggcgcagaatgaagtggggacctgcaggagcccgggtgctctccgaagcggtgacaggctgagagctagaggctgcgagtgggcaaagactggcagtctgttcaaagaaaaactttagacgaaatacatttaataaagtttatttgagcatgaaagggttcacggatcaggcagcactggtgatggggagttcagagagctgtgctgcagccgcgtaaagagcgggaggaggaatgtggaggcagagaaaggagctcctgaatcggctgcagtgaggcgtttgcctcacttgggtgtgatacagtgggtggtccctagttagaggttagatggcagtttctccttggccaaacttgtgttttgctttactgtttacgttgggcttaagtttgcttgtgtaggaatccagggcatgggagctgtcccagccttttgatctaattacatttctttttaactaggtcaagggcgtggcacataacctggcccccagaagggctggagcttggcatttttgtgctgaaaattgaggaaatagggtgcagaggaagagactgtttggggtcctgtggagatggggaggagtcaggtttaattctcagggcagtaggatgctgttggctgatttaggcctctcacaaggagcagaaaatgccaagtctgtattctcccagcttctcctgcagcgagggctttggtgcatgacctgggctccaccaatcaaatgcacccactgcccactgagtctgaggcccaaggtgggaagaagcaggggccacagattcagtggatcagtggtggctgcattaggccactcttgcatggccataaggaaatacctgagactgggtaatttataaagaaaagaggtttaaatgcgggctgtacaggaagcatggtacaagcatttgcttctggggaggcctcaggaagcttttactcacggtggaagggggagagggagcaggcacttcacatggtgaaaacaggagcgagcaagcgagcgtgccagacacacacacacagagacagagagagagaggcagagagagagagagtggcagagagagacagagagtgcgcgagagagtgagcaggggaggaggtgccacacacttttaactgaccagatcttgtgaattcggagctaaacctcactcatcagcaaggggatagtccaagccattcatgagggaactgtccccatgacccaaacacctcccaccaggccccacctccaacattggggattacaattccacatgagatttgggcggggacaaatatccaaactatatgaccatggttctcatggcagcaccctgagtcccacagtgtctgtgcccactcagttgtgggtgggagccacaggggaggcctcccctgctcagcactcctgggatttggaacctcgttcctctctgcaaagcctcctagcccggttctccagccctccccagaccaatcatgggatagtgccgtaggcctggcagttcttctggacccgctgttgctggctacccagaatgcagcggcccttcctcttagttctcttagggattttgagagaatccctcactgtttgcaattttggtggcaagtagggccctgtcacaccattaaacgcacagggaccagctcttttctttctgcctgggcccagctatggggtgggcatgtgacttgggcttggctaatcaaatgccttgtcctgggtctctgaatctgaacctgaggtgcctggacaggggtggctggaggcctggacccaggtggtggcggcagcatgctggctggcctgcccctgctcttggcctatgctctggttttggaatccctggggaaattccagcgttccaaacccggttcctggtctcctgccctttccataagcctctaggagccagatgagtagtcctcactgtgcctgagagagctacaggctgtcccggtgcaagctggtcactgactggcgcatgctgcccgctctcttggccgccatgtggtcctttcgaggcagctgccttccctcaactctgctaaatcctcagcaccagctcaaagtatcccctaggtgggagcagctggagggcaggggtgtgtcttgctcacccctgtgttgggcatggccagagaggggcggggggcagcggttcctcggggagtttttgtaggtgactctactggctcaggctgaccctatccgagcacactcgcactgacattcacagcccctcctgggcagtcccacgtgaccaagcccccaactctcttcaaatgaagaagctcctcacacgtcccaactggggccatcgtgttccatgagccccagagagtggtcagccagtgagtaagtctgggggtggcctgcatgtagcaacacagccaatggtgagttctccgttttcaggtctggggctccacccgtgcccgagttctccgtttcagaggaaagaaagcaactcaacgtctctggctccctcccactttcctctgccactgccctggaagggccatagacactccatgtccaccatggactgcagagctgctgcccacctgtgacctggtggaggcagggtgccggtgctgaggccctttgggtgggcaggtctgggggaagctctcggagctgaaggtgagggccttggggagcccccaatccagtgtaagccctgctggagaaggcttcccagccccagttagagttgggtccttcccacagacactgctgccagctaggtggcaccagtcaatgggaagggggcgtctggcaatgcttcagtggtgggggtgggggtgtaggagtggctgtgctgtgtgagtgtgcatggtgtgtgagtgtgtgtggtgtgcgagtgtgcgtggtgtgtgagtgcatggtgtgcgagtgtgtggtgtgcatggtgtgtgtggtgtgcatggtgtgtgagtgtgtggtgtgtgagtgtgcatggtgtgtgagtgcatggtgtgcgagtgtggtgtgcatggtgtgtgtggtgtgcatggtgtgcatggtgtgtgtgtgtggtgtgtgagtgcatgtggtgtgcatggtgtgtgtgtggtgtgtgtgtgtggtgtgcatggtgtgtgtggtgtgtgtgtggtgtgcatggtgtgtgtggtgtgtgtgcatggtgtgcatggtgagtgtggtgtgtgtgtggtgtgcatggtgtgtgtggtgtgtgtggtgtgcatagtgtgtgtggtgtgtatgtgtggtgtgtgtggtgtgagtgtgtgtggtgtaaatggtgtgcgtggtgtgtgagtgtgcatggtgtgcatggtgtgcgtggtgtgtgagtgtgcatggtgtgcatggtgtgtgagtgtgcgtggtgtgcatggtgtgcgtggtgtgtgtgtgcgtggtgtgcatggtgtgtggtgtgtgcgtggtgtgcatggtgtgtgtggtgtgtgtgtgtggtgtgcgtggtgtgtgtggtgtgtgtgcatggtgtgcatggtgtgtgtggtgtgtgtgcatggtgtgcatggtgtgtgtggtgtgtgtggtgtgcatggtgtgtgagtgtgtgtggtgggcatggtgtgcgtggtgtgtgaatgtgtgtggtgtaaatggtgtgcgtggtgtgtgagtgtgcatggtgtgcatggtgtgtgtggtgtgtgagtgtgcgtggtgtgcatggtgtgcatggtgtgtgagtgtgcgtggtgtgcatggtgtgtgtggtgtgtgagtgtgcgtggtgtgcatggtgtgtggtgtgtgtgcatggtgtgcatggtgtgtgtggtgtgtggtgtgtgtgtggtgtgcatggtgtgtgtggtgtgtgagtgtgtgtggtgtgcatggtgtgtgtggtgtgtgtgcatggtgtgcatggtgtgtgtgagtgtgtgtggtgtgcatggtgtgcatggtgtgtatgtgtggtgtgtgtgtggtgtgcatggtgtgtgtggtgtgtgagtatgtgtggtgtgtgtgtggtgtgcatggtgtacgtggtgtgtgtgtgcatggtgtgcatggtgtgtgagtgtgcgtggtgtgtgtggtgtgtgtgtgcgtggtgtgcatggtgtgtgtggtgtgcgagtgtgcatggtgtgcgtggtgtgcatggtgtgtgagtgtgtgtggtgtgcatggtgtgtgtggtgtgtatgtgtggtgtgtgtgtgcatggtgtgtgtgtggtgtgtgtgtgcgtggtgtgcatggtgtgtgtgtggtgtgtgtgcgtggtgtgcatggtgtgtgtgtggtgtgtgtgcgtggtgtgcatggtgtgtgtggtgtgtgagtgtgcgtggtgtgcatgttgtgtgtggtgtgtgtgtgcgtggtgtgcatgttgtgtgtggtgtgtgtgtgtgtggtgtgcgtggtgtgcgtggtgtgtgtggtgtgtgagtgtgcatggtgtgcatggtgtgtggtgtgtgtgcgtggtgtgcatggtgtgtgtggtgtgtgtgtggtgtgcatggtgtgtggtgtgtgtgtggtgtgcatggtgtgtggtgtgtgtgcatggtgtgcatggtgtgtgtgagtgtgtgttgtgtgcatggtgtgtgtggtgtgtgtgtggtgtgtgtgtggtgtgcatggtgtgcgtggtgtgtgagtgtgcatggtgtgcatggtgtgtgtggtgtgtgagtgtgcgtggtgtgcatggtgtgtgtggtgtgtgagtgtgcatggtgtgcatggtgtgcgtggtgtgtgagtgtgtgtggtgtgcatggtgtgtgtggtatgtgtggtgtgtgtggtgtgtgtgtgcgtggtgtgcatggtgtgtgtggtgtgtgagtgtgcgtggtgtgcatggtgtgtgtggtgtgtgagtgtgcgtggtgtgcatggtgtgtggtgtgtgagtgcgtggtgtgcatggtgtgtgtggtgtgtgagtgtgcgtggtgtgcatggtgtgcgtggtgtgcatggtgtgtgtggtgtgtgtgtgcgcggtgtgcatggtgtgtgagtgtgcgtggtgtgcatggtgtgtgtggtgtgtgtgtgcgtggtgtgcatggtgtgcgtggtgtgtgagtgtgcgtggtgtgtgtggtgtgtgagtgcgtggtgtgcatggtgtgtggtgtgtgtgcgtggtgtgcatggtgtgtgtggtgtgtgtgtggtgtgcatggtgtgtgtggtgtgtgagtgtgtgtggtgtgcatggtgtgtgttgtgtgtgcatggtgtgcatggtgtgtgtgagtgtgtgttgtgtgcatggtgtgtgtggtgtgtatgtgtggtgtgtgtgtgtggtgtgcatggtgtgcgtggtgtgtgagtgtgcatggtgtgcatggtgtgtgtgtggtgtgtgagtgtgcgtggtgtgcatggtgtgtggtgtgtgagtgtgtgtggtgtgcatggtgtgtgtggtgtgtatgtgtggtgtgtgtggtgtgtgtgtgcgtggtgtgcatggtgtgtgagtgtgcgtggtgtgcatggtgtgtgtggtgtgtgagtgcgtggtgtgcatggtgtgtggtgtgtgagtgtgcgtggtgtgcatggtgtgtgtggtgtgtgagtgtgcgtggtgtgcatggtgtgtggtgtgtgtgcgtggtgtgcatggtgtgtgtggtgtgtgagtgtgtgtggtgtgcatggtgtgtgtggtgtgtgagtgtgtgtggtatgcatggtgtgtgtggtgtgtgtgtggtgtgtgagtgtgtgtggtgtgtgagtgtgcatgctttgcagtgtgtgttgggcagggcggcttttctctcagctggtctcatcttctctgacaggagctggagacttccagtggcttccctctcgcccaccaaccacagcaagggcatgagggccacctccagcccagggcggcatgcctcccttgcaaagctcagccaactggggggcacagcaggctggctgctggggggtgctctgtcaccaattccccaccctgctgcccctgcccgaagcttctgggacatgagtaaaacaccagaagctttgagggacgaagtgagagctttctccacaggcctcgatggcaccattcacatttccttctcagtctccatgctgtgctccccgtctagacttgaggtccaaatgcatgttggcctggccccttcctgcacccgcctgcagcccctgcaccccacccacccaccctgtccaccgcgagtgtcaggtcccagagctgacgcaggccaagggccacagcttagagagggtaaagcaccttgctgcacagtggacagcctccctcaaagcccagtacactctgcccggctcctgtctgtggagggggagatggtattcagcagaggggcattgggtccccgctgtggagagactgcttggtgagtgacttggtgcctgcttcttggggcattcgggaactggcctcgagcagctcctccagagggatttggtgtggaagcctgagtattactgagaggccaccctgggctttggggtacaagtccactggagaagggctacagagaccctcctggcagccatctacccagggagccaaagatttctgggtgagcaggggctcagggctcagggctcagggctcagggtggccaggaaggaaatgcttggtgagccgtggctgagcctggcagcctcctgtcgcctcactgggcaccttgtaggacccaaagcccatgtctccatgtcttttgaaggtttggggctggagaagctgccaaagccctgctcccaggcaggacaggccccagaatcgttgtgtaagtgcacagctgtcttgctggctttgctcccaatggcctgggcatgggccgctccccgctcagtggctccccaggaactctggatcctctttgggtagaggggcattaggttcggctgagcagtgcaggtggcacacctggcaaagcagggtgtgggggcttggggaacctctgaagaaggctgatgtccccagctgcacatacagaggggccagcaagggtcaattgtgcggcatcccctgggctgcagtggcacaagtcttctcagaatgccctgtcctttatggtctcaggttagggttgggcacaggagaaatttgcttgagatttggaaagaagaaatgaagccgaagctgtttttcctttaaacgcccaggaggttgtggtaggccgggagccatagcagaccctccggggccttcatctgctgcccccaccacacccctgctttccacttcttccggcatggggtgggcatgactcctgctggtccctggttgtgaaggtttgaggtgctccacctcggctctgtgatgactgtgatcccacaggtgggagttcttcttgggactaaaccttaaccagcacaccacaggcctgggctggagtcaagcttgttcccagagcaccttcatccactctacctgcagggccctcctgccctggcctacccggcctggccccctctcccagcctgggactcctcaccctccctgctctgctctgtcctcctgggactcctgagagatgcttgcagtcagggcacccgctctccttgcctgcggacctcactgccttggcctttcaggagttactccaggccacatcctctttaacgttttcccaagtggattgaaggtccttgatccaatgtcccaggtcacagtttaagaaacagtccagagttgcctgaaaagcctcatcttgccagctgagataggctgggtcttcctggcctggagtagccttcaagcaggagctacagatgccccctccccagtccagagctcctggaagtttgcctcccagtgactgacatggtctgggaacagatggagctgagcactatatattatatatgggcatggcctatgatgttatctgcttgcaaaagatacagactaaagaaacaacattccttcatggtcttggcacttttcttttttagttatacagaaaaatgatgggctggccttgcttcaaatacaacttcaaagagaaaaataccattgaaaactgctacaatctcagaccacaaattagccagaggcccagccgcacattgctaagtctggacagggagtagagaacaagccgagccgagccggcaatgcctcctcagaactgaggcagaaatcagatcgcccccaagctaagggtcactgtccccaaagtaatagaacacttgaaaacaaatctctgactagattaatgaaattgaaggccacaggccactggtgtggcagaacatcccggtcagatgatgcggacgagggagacgatgggaagatgctggtgaaatccagtgcctttgcaaaccaatgcgggttgtacacatacgttggcaacagcgacaacggcaaaaacaataggtggaagggagagctaagagcagatgaaaaccacaaggaggaattacgagaaaacgcagaaagcccccagacaaaaaaaaaaaatgctccatagactcagagaaagtcctgaaaacatgactctcagaacaaaagacacagcttaaaggagagatgcagtgctcagagaagagatgacaagaaaacagaaggaaataaaatgaaggtcgcagagctcagggaaaagaatggaagaaaagaataaaaatattaccaggatgaaaatcccatgcaaagcaatgacaatttcaggaaactaaaccacagacatactggtcatctggggacttcgtggcaagacttgaagaagtcacatgacacaaagcggaagagagactatggaagatagaaaaatagacactgcgtacatagcatgatattcctgaaaaacagcacaaataaaccaaataaaacagacttggaaagaatcatgttggctttagacttctctagatcagttcttaatgccagaagacagtggggcaaggtttaccaacttcgaagtttgtctgaagtttacaaacttcggtttgcttcaataatgttatagccatccaaaaaacaaaaaggacaataaaattgagccaattaaaagatgtaataaaaaaagaactcagaaatgcaggaacaattgcgaacattgaatccatttatatacagatcaaatattaaacaagtgtggaattacgcattggtgcctcctatagaatttaaaggtgagaaaccttgacattagaaaattaacaaagatcccaggtgaaggactgaggctgaggagagatgtcttcatctgttacagcaaggaatcgtcaggcactgtgttagaacatgcaattattattattattatttttatttttattattactattattttttgagacagagtctcgctctgtcgcccaggctggagtgcagtggcacaatctcagctcactgcaacctccacttcctggattcaagcgattcttctgcctcagcctcctgagtagctgcgactacaggcgcgtgccaccatgcccagctaattttttgtatttttagtagagaccaggttttactgtgttagccagggtggtctcgatctcctgacttcatgatccgcccgcttcagcctcccaaagtgctgggattacaggcatgagccactgtgcccggccagaacatgcaattattataaacagaatatttcaaatagcttagcatttttcatagttttattcctttagtgggatttttttttttgggaactaatacttgtgaagaaacatttattacaagttcaacaatcctttcagctttatttcagtttgttttctttttaaaattttttgagctggggtctcactctgttgcccaggctggagtgcagtggtgcaaccacggctcactgcaaccttgacctcctgggctcaagtgatcctcccacctcaacctgctgagtagctggatctgcaggtgcatgccaccgtgcccagctcatttttgtattttttgtagagacaagggtctcactatgttgcccaggctggtctcaaactccttggctcaagttatcctcccacctctgcctccctaggtgctgggattacagatgtgagctaccacaccaggccctcagtgttaacaaataagatgagtatactacttttgattaaacacaatgtatagacatataatgatcccatttttgttgagatgggtcatatacataccacaaaattcatcttttccaagtgcacaattcagtggtatttaatatgttcacagagttgtgcaaccatcactactatctacccccagaacgtttctgtcaccctaaaggagaccctgtccacatcggcagtcactccccactcctcccagccccagcccttggcaacgacttatttgtttccatctctgtggattggtctcttctggacatatcatacaaatagaatcacaatatgcggccttttgtgtctggcttctttcactgagcacactggatgaccccattttggggaaattgttctgccacccaccagttccttcatcagcccgtctttcacagtcctgggtctggggtgatgttcatggtggcattctaggtgctgcgatgtggggtggacacaatgctgccctgaacttttctgtggtgctcggccttccctagcaagcctgccctctctctcctgctttccttgctagttggctcatggtggtctctctctgcttctcagttattgattcaaggagtatttgctgtgctcctcctgcgtgcgagtgagtggggctacgggcctggtctgaggaggtggcaggcagtgtggagaggagtggtggatgggttgggggctgctgaggggcccagatagcaggagttcatgagtaatgagcgaggtgcctggtggggtgggggtttctggatgacgctgaggggttcagcctgggctgctggcatggaagaacccatggtgagcggggggatgagcaagacattggactggaagtcaaccaggtacagcaccacctttccccctgtgggcagcctctgccagggcgcagacctcgccttgacagccttctcctctgggttcggtctctcacttccgccatcatgctgggagagcgttgagggagtgaatgccttataaggggagagaaatggactccaggctccagatgctactctcgtgtcagtctgcccctggcatggggtgcatgtgtgcctgtgtgtgtgtgtgtggtgtgtctggtgtgtgtgtattcacgtggggggtctgtgtggtgtgtggtgtgtgttcatgtgtgtgctgtgttcatgtgtggtgcatgtgttcatgtgtgggtgtggttgtggtgtgtttgttcatatatcgtgtgtgtgtgttcatgtggggtgtgtggtgtgtgttcatgtgtggtgtgtgtgtgatctgtgtgttcatgtgtggtgtgtgtattcatgtgtggtgtgtgtgttcatgtgtggtttgtgtgttcatgtggggtgtgtgtggtgtatgtggggtgtgtggtgtgtgtgtggtgtgggctgtatagggggtgcaggctgtggggcgtgtgagttttcatgtgtggggttgtgtaatgtgtgtgttcatgagtagggtgtgtctgtgtgtgttcatgtgtagtgtgtgtagggtgtgtgtggtctgtgtggtgtgtgtggggtgtgatgtgtgttcacatgtggtgtgtttgtgttcatgtgtggtgtgtgttggctgtgtggagtgttttccatgtgtgttgtgtgttttcatgtggggatgcatgtggggtgtgtgtagtgtatgtgttcatgtggggtgtgtgtgttcatgtgtggaggttgtgtgatatgtgtgttcatgtgtagggtgtgtgtcttcatgtgtggtgtgtgggggtgtgtgtgtggtctatgtgatgtgtgtgtttgtgtgtggtgtatttgtgttcatgtgtggtgtgggttgtgtggggtgtgttttcgtgtgtggtgtatgtggtgtgtgtgttcaagtgaggtgtgtgtggtgtgtgtgttcatgcagggaactgtgtgtggtgtgtgttcatgtgtggcatgtggggtgtatgtgttcatgtgtggtgtgcagggtgtgtgttcatgtgtggtgtgtgcgtgttcatgtgtagggtgtgtgtgttcatatgggactatgtggagggtgtgttcatgtggggtatgtgaggtatatggtatgtgtgttcatatggggggtgtgtgtgttcatgtggggagtgtatgtagtgtgtatgtgttcatgtgtgctgtgtgtgtgttcatgtgtggtgtatttatgtggggtgtgtggggtgtgtgttcatgtgtgtggtccatgtggtatgtggtgtatggtgtgtgttcatgtgtggtgtgtgtgatgtgtgtgtgttcatatgtggtgtgtgttcatgtgtgatgtgtgtagtgtgtgttcatgtgaggtgtgtggcatgtgttcatgtgtgggatgtacgtggtgtgtgctgtgtgtggtctgtgtggtgtgtgtgttcatgtgtggtgtgtttgtgtgttcatgtgtggtgtgtgtggggtgtatggtgtgtgtgtttgtgtgtggggaatttggggggtttgtggtgcatgtatttgcagagcttcccatagatggagccaggcaaccaacatttcccagaggtgggtgatgccctcccacagtgccacacctccccagtcctggaactgcattgggtgacagagactgggcaagaggccagaagcctggccccctccccagcagctctcacacagcagctgcagaggctcaccctagcctgtgactttctgatgtttccccctttctgtctgtccctggctctgtcctgcctctctgtctgtgtcacacacagagacagcagaggggcctccaaggaaagctgagaccccgctgggtacaaggtaacactgtgtggcttccaagcaaagccaagaattatctagcccttcctgttctcggaactgtgctgtttcctagacaacgtattttgtgtaatcatggtcaaggcaacgtacatttctgcccagaatcaaggtcacagtataatactgattcaccacggcaacagcagactactcatctgacatgggagatgagatttgcgatgaaaaccacatgcagattgctagttgcccagcgactctgcaccacgaaataggtttgactccagtggaatctggaatcatgtccttaaaagacacagagcccctggtagttcaacatatgtaactggccagccagagccagccaggcacatggcgccactggtagacaaacgtgcacatgacaggagcctttccacctgccctggcttcaggagtttagctcagtccacaaatccacgccaggagcatttccctatataaacaagccctgcgatgctcctagtccatctgagctcactgtggaccaagaaaggcgaatggtagttctagaagaaaatcttgtcatttaggatttgatctttttcctaatttctcagcccaagatcaactgttggtgaccccctagctctcacacctctcttctctggccccctgaaatcagagagaggcagcagggcctcctctatttcagtaagcttgggcttggggccattatgcggtctgtgggtctgagtccccaaggcctctggcttgggctgaaggagagaagtaggaactggggccctccagcctgtggggtgaggtcttcatgaaggtgaatagctgaaccgtctcccctgggactcctccaaccccactgttgcttcccaggagaaaaggcctttggtgcctgtctgaggccttgaaagtcagttttaagtccacctcccagacaatggcaggtgatgggtctctggggggcccagctgcattgtattcacgtcaccagtatccagccagaaaggaggccgagatcacctggggaggtcaccctcaccttctgctgatgcccagaggagctaggtgacagattttgtcaaaagattcaaatagcccagcgcacatccccattgggtgcctggtgccctcacaggccacctctgtctcaccctctggcctgaaggccgccctcagtggccccttgaaggtcagctgacctcttttccacctgctttggtggcttctattgcagagccccgaggcctcgagattgagaactgggaggatggccagtgctgacaaggacagctatcctgggtgacagctcggccaacagaaacatgctctaactcagagtcctgtgacttaggctggggccgccagtctgtgcacggctgcccaggaagggctgcaggcagcttccgtggccatgcgggccagggattacagcccgcctgccaggaaaccctctcagctccactgctttggttaccaactttcctctttcctaaacttacaatctgtttgcatctcatggttcaaggaaatgccagaagcgctttgtagcagatgcagtgctgggcgcttttcctcacctcacttcatttcctccttacaagccattccctttgctgattcctcgggggctgggtcctgggacacactggtaagctgggtggatgtggctccagagagcccaggggacgcatggaggtggccatcaaaaaagaacggactgggagaagtactgtgaagtgacccagcaggacaaagatgactggcagctgggctccaggaaggggctctgagtaggtgaccctgaatctgaaacctgagcgaggcaagagagcgttctacagaagaggggcacatgggccacggcctcgtgcagcaggcaggatggaaatggttggacatgttaggaaacagaggctcacattggtgagtgtcacgagtggctctgacgtgttagagcttgtgacagatccctgctatctcagagctcctgtcaccagcaagatttgtgacagatccctgctatcctcagagctcctgtcaccagcaagattgcttcaggccccacttctttcctggcatgatgcccatctctttctctcttgaggccacgagcttcatgagggttctcgaggcaccccagcccttagcctctgcctctgtgcagtaggtgttgatgacacaaccatgcgtggagcacccacttgggctggccccgggttaggagctcagggcacagacatagaactcagagtttggccaaggagatggaaaactccctctacaccccactctcggcatccaggtgaccccagtgatccctccaccttacctcccggcccttggaggtgggcactcagcagtcttctccccactactccctcccggccctgcattcttgcctgggctctcctcctcccccaggcctcccactgtgcccctgcccttggcccttgcgtctgccttctcctccacctcctgccttgggcaaggctggcatgcatccaaggccatggccccatgtgccacagtgggaaggcgaaggggccgcaccccctctgccctgcgatgtcacgtctggcactgcactcctcccctttaggcctgccccatctagtcatgcttgtctggagtgtccctgctgttgtttatcccccttgctcccgcactctcatgggtgcaccctggacctgcccaccgacctcccactcccaagcaccctttctcaatggaagcctcttcttccttcctctacatccccgtgaccttgatgggagagagcaacagcccttgtccccgcctaccttggccccaacctcttccaggcctcctttcttcaccatgcagactccaggactgcccctcaaccgccccttcagcacttcccgccaccccttgttcccctgccttcaacgtggccgctccatgaaaccgcaactgaggacctacaggcagaggatgaaagcgaatgcacccatcccccacccccattcactgagtccccactgtgtgccagggcaggcactatgctgggtgctggggtacagcagtgagccaagatccgccagccttcctgcccttgtggaggcagtggtctagacattaaaaagtaacttcccagttaggtgacaactacaagtggtgacagtgatgtataggcgaatgccaggtgttctgagagcagaaaaggagttctggtgtcatctaggaggagaaagggcagagaagagtccctggaggaagggacatttgcactataatctgcaggggtcccatctgcatttggggtagctgcttaccccaccctgtgtcacccttgctggcagggcccctatcttggggtcacatgctcagccctcccgccaggggccgaattgccattgtaaggggattagttaggcattgctgtgggagtgattaccgcaaacttagcagctgtcacgaacactcctttctgtgggtcagaagctctgggcatgaagtggctgggtctgaggctcagggtctcacaggctgcactcctatctggaggctctggggaataacccacttccaagttcatgaaggttcttggccaaattcagctccttgtggctatcggactgaggtcccattccttgctggctgtcaacaggggccgctctgggcttccccatcttcaaagccggcagaagagctgttgtctcattcaacccctttcacgcctggactccccgacttctctgtctctggcctctagacccagatttccagggctcatgtgattaggtcaggcctactgaagagagcttccctttcttaaagtcacctgtgccatgtaccataacccgatcataggggtgatggtccctcagattcaccacctggggtgtcacattggacttgtaccccaggggatggggaactgggggctatcttagaattctgcctaccactggaagcctcctgtgggggtctcattccatttgctggtgggtggtttaggcagggtaggggtggatccacagtttatggagcctaaagtttatgaatttggagggacctctttaaggaaaagaatataaaattacaaatacaaaatctctgggacccctcccaggacctgagaagaagtctgtgcagtgaagggccctaagctcatacagggggctgtggtgggagcagaagtcccaaatcagtttcactaggccacagttaagatgccagcagggccacaccctctcaggaggctccaggggagaatcctgttcacaccttctccagttcacacctccagcacctccagccgaattccttagctcacggacacttcctccataattaaaacaatttttgtgggtacatacgtagtaggtgtatatatttatggggtacatgagatgttttgatacaagcatgcaatgtgaaataagcacatcatggagaatggggtatccatcccctcaaacatttatcctttgagttataaacaatccaattacactctaagttattttaaaatgtacgattaagttattattgactatagtcaccctattgtcctagcaaatagtaggtcttatttattctttctatttttggtacccattaaccatccccacctccccctccagcccctcactgacccttcccagcctctggtagccatcctgctactctctacctccatgagttcaattgttttgatttttagatcccacaagtaagtgagaacatgtgatgtttgtctttctgtacctggcttatttcacctaacataatgacctccagttccatccatgtagttgcaaatgacaggatctcattcgtttttatggctgaatagtactccattgtgtatgcgtaccacattttctttatccattcttttgtgttgatggacacttaggttgctagcaaattttggctattgtgaacagtgctgccatgaacatgggtgtgcagacatctcttcgatatactgatttcctttcttgtgggtatatacccagcagtaggattgctggatcgtatggtagctcaatttttcgttttttggaggaaaccccaaactattctccatagtggttgtactaatttacactcccaccaacagcgtatgaacagtgtactttcctctacattcttatcagcatttgttattgcctgtcttttggatataagccattttaactggggtgaggtaatatcacattgtagttttgatttgcattcccctgatgattaacgatgttgacatcttttcatatgcctgtgtgtcattttatattttcctttgtgagatgtctattcaaatcttttgcctgtttttgattagattattagatttttttcctgtagagttttttgagatccttatgtattgcaaatattttctcccattctgtgggttgtctcttcactttgttgactgttccctctgtctttaaagccagcagcaccttccaacctctctgtgttccatcacttagtcttctctctttttaaggatgtgtgtgactatgtttggtccacctagataatccacccagaaaatccacactcatctcctcatctcaaggcccttaactaaatcccatctgcaaagtctctttttgccatataaggtcacattcacaggttccagggatgaggacgtggacatcttttggaggccattgcatgtccagtggacttggccacatggaccctgagccttacatgagggacagaagcctgagagcacagccaggggtgagttttcccctctggaagattctgctctctgcagggatctacagcacaatctgaatggaatgtcagaactaagcctagaggctttaatccctgtaacagccgagtcccatgtatccaggacttaattatgcttatttgggaacaggaaggattggaaaggccctggcccagctgggaaccactgaatccaaattggagcccacggagggcaaggcctgctacagctgcctagaggggtgacatggcagagggatctgtccatcaggaactaccctggggcccagccagttaggggttgagggagcgctctcataactgtcctgtttcctgtttcatttgctttctctgcttattttgtatgagcacacattaagccatgttggcttcaatatgaaatcaaggccactccttggtctccaaagggctgtgtgcactccccaggccaggtggctcaggcctgaggatctctttcccacctcctctccagccacctggctgacttgactctgccacaggtctcctgactgggctggccctctctcctctggaccaccccaactgccttctcccagcttgcctggcaggccagagtctccaaacccctctgcctgcagccactgagagccctggacgctgcaagccgtatctgccctcttgggcttaaagccaccctggggaacggggcacgcttccagagggccatgctttccaggggtggcagagctggcctgactcctccacagcctcacctgccccctcctttgtgtgcacagaagccaccagggtgacacacgtatgtgccttggacacatgccatccttgcctatctcagcatttgctcatgcttctttgatcaaagccttcatttccttcaggatctggcctgattctacctcttgcaggcagccttcctcatagtatcagcctttctccctacccaaagttctcactgggctgggctgctctggcaagtagacatcccactctgcctggtacactatgggctttagtgtcctgtggctgccagaacaaagcatcataaactgggtggctcacaacagagaaagtggatcctctcccagtcctagaggccagaagttcaaaatccaggtgtctcagggccacactccccccagaggctctagggaaggctccttcctgcctctcccagctccagaaggctccaggcatcctgagcttgatggctgcctcactccagcctctgctgtatgtctttctcttcttctgtcacttacaaggccccttgtcattgaattagggctcacgctaatccagaatgacctactttcgacatctctaccttaattatatctgcaaagacccttttcccaaaggcggtagtctcttcttctcctctgttttactttctgtggtttcagtgacttgtggtccaaatatattaaatgaaaaattccagaaataattaaaagttttaaattgtgcacccctctgagtagcatgataaagtcttgttccgtcctgtccagcctgtgaatcctccctttgtacagtggctccacgctgtcaatgcctccctgccaattagccacttagtagccaccttggttctcagaatgactctcccggtatcacagtgcttgtgttttcttttacttaataatggccctaaaatacacgttgaggttgctaagagctgcagtaagaacaaatcttccatccatgaaactgtgaagaaggaataagaaatttgtgctagtttttgaagctgcagaaattatggctggataaaagggaggactcacgcttcgggtaggatggagcaggcttgaggtttcatcacgctactcagaagggggcgccatttaaaatggtttatttaattgaattgtttatttctggaagtttccacttaatatttttgggccgaggttggccacgggtaactgaaactgtggagagtgaaactgcagataagcaggggactaccacaccacccaggcatgctcaggaccccagtggaaaatctctccctctgaggacaaactctcagactgcaagcataaaacacaccacgagtccagtgccctgaaagagagtcctgggaaattccaaagaaagaaaggaggactagcacccatagaagaaaattgggaggtcacagaacaaagataggcagataagaaacgccaaggtgaaatcttagaaagtaaaaatgctcattgaaataaaatcttaatagatgagtgaaacaccagagtggacagagctgaaaattgggattcactcagatttgggagtggatggatttgttccagttgccataacaaaataccacagacttgggggcttcaacaactgaagtggatccaggttaattggcaaggtgggttccttccggggtctgtgagagcaggatgtgttccaagactctctccttggcttgtagatggccgtcttctccctgtgcctcttcacatcatcttccctctgggtgtatcatctgtgccccaatttccttgttatgttcttataaggacatgactcatattggataatggtccactctgatgattttaacttgattacccataaggtcacttcgatatttgtcactttgtctcaaatccttttaatctatttcttcattatttcttgtgctaaaaaaagtccttgctttcaccttttatgtccctcaatacattatctgttgtgtttttgtgctccttccaatttagttttcatttttaacatttaaaaatcttgtttctaattctttcctgagtcctatcacctaatttccgagttttgctaattctgatttatgtttttctttcatgtcttgcattactttcttaatttctttctgcttgtttgggaaatcgtaattctagtttggatttgttttgaggacataactttctggtgtgcttgctgtctttccagataggaatctgttcttttcagatagataggaatctgttctttatttgctttttttttttttcttacagtacagcttttttttttttttttccaaacagctttcattataagaaaaggtatgggattttatcacgatagttttcatgtgaaattatttttctttaacttttagaaggaggcatggttcaggatagcttttctaacttcacccatctccctctttctttcattgttttcttttaatgataaaaaatgtggtggtgtgccttctgaaacttctggctcaattcctccagctgaccttgagctagatctcctctttcttttggctctgctctctgtgttttccttgatttcagcttctctccagcagtttcccccagtgtggggctctatcctagaagggagcactgtctggcaggtttcaggtactcacagaggccagaccttactgagggccccttttgttcacttgccattgccttcagcaaaacccctcccagactgagctgctgttctcaaattggcctgcctggttttccaatgagcacctgttgactactttggtgtcccctgttctcaagtcagtcacctgtccttttgttccctgggcttaatatgatcttggcattgtagttatgttaatagagtatgttttataggcccacacttacaatctatgagagaaatcataggatgtctggactttgcttcaaaataattcaagaaattctgggaagatggcagtggcatgaatctttaatctccccaaatcctcacataaaacagaaccctgcactcaggctgctctgtggattttgtggctcttggtggtttgcacccaccgacttgtattttggagctcattaggaagacctttccagcttgcactgttgtaaatgttgtctttggagttttgattctgccaccggttctgttttatgcaaggatttggggagattagagagctatgccactgccatcttcccagaatttcctgaagtattttgaggcaaagtccagacatcctatgatgacatgatcacactaagaattagtgataatttctaattattgtcaaatagccagtcggtattcaagctctccattgtcacatatttcctttatagtttgtttggataagaagccatctgaggttcataaattgattgatagtggttttatgtttttgtttgtttgtttgtttgtttttttgatagagtcttgctctgtttcccaggctgtcatccaggttcactgcagccttcatctcccaggctcaagccatcctcagcctcctgagtagctgggaccacaggcgtgtgtcaccacacctggctaattaaaaaaattttttgttttagagatggaatctcgctatgttgcccaggctggtctcgaatttctgggctcaactgatcctcctgtgttggtctcccaaagttctgggattacaggagtgagccactgtgcctggcctggttttaagtgtcttttaatctacaggttctgcctctgtttcttgttttccccttgcaatgtatttgttgaataaaacagtgttattcatactgtggcattccccacagtctggatattaatggctgcagccctgtagggtagtaaactctgtattttctgtgttggtagttggattcagaaggttaatcagatgtgagttcatttttttttttccaagactaattcatatgtagtgttggaagactttaacacacctctgtcggtaattggtaaatcaagcaaacaaaatacaagttaggatatggttttgaacaggaactggcagcttaacctaatgggcatatgtggaacatcacacccaactgcagactgcacattctcttgggcacacatggaatatttataaaaaccaaccacaaactggaacttaaagcaaatcttaccatgtttcaaagggttaaaatcattcagagcgtgatctctgaccacagtgtcattaagctagaaacccaagagaaagggaaaataaacagcagaccctgacatttggaagctggcctggcccttgcagggaggccatgctgttctcctattggacataaacaatctcccagaatactaacctcagacaaggttacttggagaccatgagaaaatgagacaaagcaaggccacttcattattttgtctaagtgcagataaaaacaaggttaacgtgcaacccacaaaataccaaacgtcctcctcctgcttggctagtgtgggtgactgctgcttctttacaaattacagctttagctttgttctagcctgccctccccagagaaaagatttactaagatacccaatcatagacttgtcctcgctctctgacagtgcttagagcaaaccctggcttcctcgggccctcctcaaaataccccacaaaagtccaaatctaataggtttttttctaacgtactttctctgagatggcgcacatctccctcactgcagagaggaagaagctcactgtatataactagaaaaatccccacgtgtttagaaaagaagaaatgcacattgaaatcatccagggctcaaggacagtaacatgggaattaataaatattttattgaatgataaaacatgctacacttctgtaacagtcagctgtctgacaggaaatgactgtcacgtgcagactgagtaatttgaggagagttcaagaaatggattgaggtggctttgtaatgtgtcaacttggctagcctgaactatgttttccagaattccctttcttataggttttggtgagatgggcaacatgagagattctgatgggagatttggagaacagaagggaaacaaacatgtaactaagttctcgtaactagaagatagaaggaacaaaaaataagaaaaatacatagactacaatagaaaaatgggccaaagtcttgaacagacaattcttcacaacatatgaaaagtgcccgacctcatttgtcatttcagaactataagttgacgttagtgggagataccattacacacccacccgactggcagaaaccaaaaggtatcacagttgcaagttggcaaagctgtgcagcagtggaaacttcccacactgctggtgggagtgtgcgttgggaaaagggttggcatcccgtagtaatattgaagacacacttcccctatgacccagcagttccactgctaagtatacaaactctagagacacttgtgtatgtgggccccagaaagcaagtgtagacggttgcaatacattgaatggtgccccctactccacaacaaaaatgatacatgcccacgtcctaatccctaggcaccatgaatgggatcttatttgggaaaatggtctttgtggatgtaattaagttaaggatcttgagattacatcatccttggttatccacgtgggccctaaacccaatgagaagtgtccttataagagaaaggcctgaggccacttgagagaggctttgtgaatatggaagtagaaagtggagtgatgtggcctcaagcctggagcaccagaagctggaggaagaagcaagaaagagaatctctcctcaaaccctcaggggaagtgtggctctgctgatgccttgatcttggatttccagcttccagaactgtgggagaatccatttttgttattgtaagtcgaccactttgtggtattttgttgcagcagccacaggaaaattgtacaatggttcatcacagcatttggtggctgaaaataaaccaaatactcagcaggggtgggatggataaatacatcatggtaatgttgtacaatggaatactctaccgggatgcaaaggaatacactctaagtatgctatagtaaggatggattttaaagacacagtgatgcatgaaagaagcaagacacacaaaaaacatacattacagttacagttatgtaaagttcaaaaacagcaaagtggaatcatatgatttatggatggatgtgtgcttcagtggcaaaactctgatgcaaagcaaggaaaagattacgaaaaatttaataagaaggtgattgcaagggacacactctgggctggggtggcggccaaggctctagcccttgatctggggtccagggggttagctgagtatgttcactttataactgtagagttttaaagtgcagaaaatgcatgtaaaaaatatatatgatttacacagtcctctgtatctaggctgtatttcacaatctgaaaagttgggacattagcaagcagaattcaaacaatgattatttgcagattatctattatatatatgtctctgcatcaggaaaaatctaagggaatctactaaaaaagttacaaagagtagggccgggcacggtggctcacgcctgtaatcccagcactttgggaggccgaggtggggggatcacaaggtcaggagatcgagaccatcctggctaacacagtgaaaccccgtctctactaaaaatacaaaaaaattagccaggtgtggtggcgggcgcctgtagtcccagctactcgggaggctgaggcaggagaatggcgtgaacccgggaggcggagcttgcagtgagccgagatcgcaccactacactccagcctgggcgacagagcgagactccgtctcaaaacaaacaacaacaacaacaacagcaacaaaaacaaattaaaaaaaagttacgaagagtaaggagaattcagtaagttgtatgggtacaaaatcattgagacaaacaataagttagaacatacaataaaaaaaaagatgccatttaataaaaacaataaaataccttgaaataaatttaacaagaaatgtgcaagatctatgtaaagaaattttaaaatgttcctcagggccatcaaaaaaggcctgagtgaatggaacggtctataatgttctcagatagaaaaagtcaacttcataaagaagcaaaatttccctacatcaatctctaaattaaagatgatcccacacacacaaccacagaagattttggaattcgtcaagatgattctaacattggtgtagaaaactaaaggagtaaaattagccagaagtattctgaaaaggaagactaatgagaggggcactagtcctaccaatataatgcttattataacataataatatatgtttgatgtgatatttaatataatacttataacataatgtttgatgtaatatttaatacaatacttacatgtgtgaggtaatatttaatataatactataacataatattttgatgtcatatttaatataatacttataacgatatatgtttgatgtaatatttaatataatacttataacataatatatgtttgatgtaatatttaatataatacttattataacatgtttgatgtaatatttaatataatacttataatgatatatgtttgatgtaatatttaatacaatacttataacgtgtgaggtaatatttaatataatactataacataataatatatgtttgatataacatttaatataatacttataacataatatatgcttgatgtgatatttaatataatacttataataatatatgtttgatgtaatatttaatataatacttataacatgtttgatgtaatatttaatataatacttataacataatatatgtttgatgtaatatttaatacaatacttataacatgtgtgaggtaatatttaatataatacttactataacataatattatgtttgatgtaatatttaatataatacttatattaaaacataaattgagagtaatttaaaagaactgtgtagtactaatatatgaatagaagacagaacaatagaaaaaacagaaagtctaaaatacatccaaatacaaacgaggatttagaatatgatagaaatgttatttcagttccttggggaaagatgggttattcaataaatggtgtagggataagtaggtggccatctgggaaaaatgtgaagttgaatcccacatcataatgtgcaaccaactaaattctggatggatcagatttaaagattaaaaaaataaagctataaaaatattggaagaaaatatgggacatttaaaatatgttggaagagagaaggccttttaaagtatgacagaagccaaaacagagaagcttgattaattcagtacataaaaacgaaaagtttcttcaacacaaaacttcctgccagcaaagtccagggcaaatgttaaaccgggaaaattatttgcaattcctgttggagacaaggaggctagttttcctattatttaatagttcctacaaaatagtaagaaaaatgacagcaacacaatagcaaaacaggcataaactaggaatacggttcacgggagagaaatacaaatgacttccaaataagagaaatccaaatcaaaactacctgctttcatttatcagactggcaaaagtagaaaagtttgatagcacccaatgttggcaagagtgtgggcaaataggcactgtcctatgttacttttgggagttggacctggtacgacttctgtgggggtaatttggcaacatctatcaaaattacaaattgtgtaccttttgacccagcaattgcacatgcaggaattgattctacagatatatttttgtgaaaagataaaagaatactagatggacattaaagagaatgaagaaattaggtgctgatataaaccatctccaacacacattgttaatttaagaaagaaaagtaaagcacagtgtgagtagcatgctagcatttgtataaaataggaatgtgtgtgtgtgtgtgtgtgtgtgtgtgtgtgtgtgtgtgtgcatgtacatgcatagaatgtcaatggataattgttgaagttgggtggtgggtacgtggaggttcattataccatgtgctatttattgcgtatgtctgaaattgcccattataaaaagttgaaaatatacttaaagtgatgacagtaaaaagaatatctctagaagaataaacaaaaactgggtaatactggttgcctccacaggcaatgtattaattaggaactgtgttcaatggagtaacagaaaaccagcagtggggatttaaacacaaaagagtttattttttccacgtatggagacataaggaagtaggcagttgctggcttttgttagttgcttgaggatgtcaagagagatctttacgattttcttggctttttttctctatccgcaccaacatagctgctgaagctccagccatcaaatatgtgttctaggttaggagaaagagaaagtgtggggatcaaacagggcagctcctggtaattcagcccactgtcaggaaccttccagaagctccacccagtgactttcactctcattttactggccacccctatctgcaaggaaggatgggaaatgtagatttgaaacttgcaacactactactcccaacaaactcagggtctctttacaaaacaaataatgagaagagtcaaaataaatggattttaaaaatgccgggaaaatactaacagagagaaagcaggtagaacaatactactatcatgtaaaatggagcccaaagcaaaaaactttctcagggacaaatatgactattcctatatgtaaaagacacaagcttaaaggcttggtgcccaatatagtttcataacatgtgaaacaaaaacttgatagaagttcagaaaaaattgacaagttcgtagtcagagtgaaagagacttactatacttctctcaggaactgacagaccaaggaaacaacaaaataaataagtatatagaggatctgaataacgcaagtcaggagcttgacctaagaggtgcacagtgtgtataactgcatctgacaatcagataacgcagagtttcttctcaaaagtatatgaaacattatccaagactgactacatatttggtcacaaagaaaatctcaagttcaaaggcagaaatcatatttattgaatccaaaacactaaaataagaaattagtaaccaaaggaaagcccccaatactgaaaataataattaataaaataaataaattgcaaaaagcccagaatagttgaaaagaccaatatttaaaaatgcacaaattcatagagatattggtcaggagaaaagaaggtgaaaaaacaaataaatataatgagaaacaggacagggtgtaaacttcagatgcagagtcaatttttctaaaacttgtaagagaatactatatataggccaggtgcaatgaagactgaggtgggcagatcacctgaggttaggagttagagaccagcctgggcaacatggagaaaccccatctctactaaaaatacaaaaattagtcaggcatggtggcacatgcctgtaatcccagctactcagggggctgagacaggagaatcacttgaacccaggaggcggaggttgcagtgagccgagactgtgctactgcactccagcgtgggtgacagagcaagactctgtctcacacacaaaaaaataatactatatatagttttatgtgaatacattagaaaatatagataaaatagaaaattttctaggaaaatacaaattataataattggtcaagaagtagaaaatcagaataaaccaatatccatagaagaaatgtaaagatagtcaaagatctatgcttcaatattgcatcagacccaggtggttatatggttaaattctgctaaatctgaattgaaataggtaattctcatattgtacaaacccttctctgcattgaaaaagatggaaagcatccaaacccattttatgaggctattataaccctgataccaaaattggaatcagattgcacagtaaaagcactgtgtagatcaatcttcctcatgaacaaaaacacaaagatacctcatatccatgaggacattacaaggatcctttatcatgtcaaagtacgggttccctcaaataatgcaaagatagatcaatattaacacagttattaatgtaattcacttcattactggttaaagggaaaacataatatattatctcaactgatgtaggaaaagcatttgataaaattcagcatctatttacagcatccttgccaacttttagtaatggactcagcctgatcaatgcgagacaagaaggaaatacagagtataaatgttggactagaaaagactataattattcagctatgttgtgctcattttctaaagaatctaaaagaagcacctgacaaatctttagtgttcatatgagatgttttcacaggctctacctttcctgcaatgaccaattaaccaatatactatttttaaaaaccttgtaatccccagaacaacgcaaactataaaatcatttgaacttaaaaggcataaaaatgcataagactgatataaagaaaaatataaaaactcactacaggacataaaagtagcctgaataaatgataagatatatcatgttattggatagaaagattcaactttgaaagacgtctgctcttctgaaattaatctataactttaatgcaaccccaataataatcctcaaaggatttcaatagaacctgtgaggcaaatcttaaatcaatttggaagagaaatgtacaagattggcaaaaaatcttaaaagaaagaacctactagatatcaaaacttataaagcaatagttaaaacagtagagtattgaagcaagaatcatcatattaattgataggacaacagaaattccagaaacacgcccatgaaaatttggctatttagaattcattcgttcattcattcattcatccatccattcagttgacaaatcatgacgtgccagacattattttaggggtgaggaaaacaaagcctctgccctcatggaagcatggagcttactttctacgtgatgaacttggcatttcaaataatcgggggaaggatggtgttgggacaattggttattcatgtaaggaaaacaaaataatagattctaactatagatcatagaaaagacaatattcctgagtgattaacaaaaagtctaaacataaaaaacaaaactataaaaaagaaaactatacaagcaaatttataaaaacaagactagaggataaagaagatgttattaagtaaggcacaaaatgcacacaccataaaagaaaagcctgatacatttgaggacataactgtgaaaaatataacttctacaggacaataaatgagccattaactaagttaaaaataactgtggggctgggcgcggtggctcacgcttgtaatcccaacactttgggaggccgaggctggcggatcatgaggtcaggagatcgagaccatcctggctaacatggtgaaaccccatctctactaaaaatacaaaaaattagctgggcgtggtggcaggtgcctgtagtcccagctactcaggaggctgaggcaggagaatggcatgaaccctggaggtggagcttgcagtgagccgatatcgcgccactgcactccagcctgggcaacagagcaagactccgtctcaaaaaaacaaaaacaaaaacaaaaacaaacaagcaaacaaacaaaaacaaaaaaacaccgtggaagaagcatctacaatgtacataacaaagggttactatcaagcatataaaaagaactgcatgtccatagggaaatcagcaaagagtatgaaagagcagtttacagaagatgccattgaatggtctgtaatagtaaaaagatgttcaacctgactgcactagtaatcagggaagtgcaaatgataaggaagtacctgccatttttgcccgttggttttggctagggtggggggacatgggaactcttgccacttggtacaggcttttttggagggaacgttgccagaatctacttttaaaatgcctgtaccttttgaacccagtaaatgccacttctggggatctgtgggtgagactgctcattgtctctctggcccaagggctattattcatgggtgctaggctgctcagtgagacgagattgcccagcatcccttggggtgagtgtggtgcccactccccactcaagctcctcctcaagtggagctgctatagcagggtccctgaaccactgtgcacccataaattgtttgttagtggtgggtccatgaccagcattaacttttaaacaaatctataaatttgtaaaggagaaaggagactttacttctttttaagggttacagcttgcaaggtggtcgtcctgcaggctgggaagcgtgcctctggccaagacaagagacaggcactttgaaggaggaggggttgggctaggatcttggtgctggacaggttagctaaacatacatattcaacaggttacaggaagagctatgaatattcataaaggggggtcctgacacatgtgtactgaacaaacatgcatgtaacatatgacccatgttcactttggggtggagacttaacatttaaatgtattacagttaggtcctatacatccaaaggtcttttcaggacatgaagtcactcaagcatgaaatctctgtaaactggcaagaacaagcatgtggctgctggtcttatcaggagaaagttactgaaatcaatctcttgtccaatcaaagctgtagttatgcctggtggaacaggggttcagttagtccatgtctgaagctggctgagctgcaattgtttataatcttgcttatttcaaggccagtgcttgtttagctgctagagaaaaagaaaaacttgtggcagtgagagcacagttcattctgtaagtataggggtgtgggacttaacctttgcgtggcatggccttaggtcctgtttataatttcgcatctaattgtcatcaagagtgtgttctgtcagtcttatgatctctattttaacaccaatgcaggttagttgttgtgtttaatctccaaaagggaggcatgtctgacctgctgtctcatcatggctgtgaactcatttttaaggttttctaatgtccccctggccaagagggggtccgttcagtcagctgggggcttaggattttatttttagtttacattgggttagtacagatattaaggcttttatagtaacagaatatcaccatggcatctttattgcaagttaaaaaatatttcactccacaattgaatgaaataaactggcttttcaccatagaccgtttgagaagtgctgtcctaaagaagagaggaaaaaggcaatgtgaggagctggggtctgtgagtgactgtgtggagcacagctgccccatcaaccaggactacatggctcagacttccatgagaaatgatcctcaattttctctaagctactgctttattgcaggtctctttgttgaagcaatgtagtgtcactctacctaactcagcatctgttgtacagctcacacctgtgcacaagagatctgagcaaggctcttgcagcattgtttctattagcaaaaccctggaaaatacctgaatattcaccaagaaggggaagggtcaaataaacctcactatgctcatgctatgaaatactgacctgtagttaacaacactctcccaacattctcccacgcttagttatgtgaagaaagtaagttgcatgataaacagctggcatgataaactgtctattgtgtgtgtacatatatgcaggtaaatatgcagaaaaatgtcaggacagatgttctcagaaaggggggtgtgattgggaggggccagacagtgactaaacggggtttttattttattcgtatttgtttaatattttaaaatgagattatattcatgttttgtttgtgtaattaaaaatgaatataaaatagacaatagtcttttttttttctgagacatagtctcattctgccactcaggatggagtgcagtggtgcagtcatagctcactgcaacctctgcctctcaggctcaagtgatcctcctacctcagcctcctgagtagctgggactatgggtgcatgccatcgtgcccagctattttttttttttgtatttttggtagagatggggttttgtcatgttgcccaggctggtctcaaactcctgagctcaagtgatctgcccacctcagcctctcaaagtgttagcattacaggagtgagccactgtgccccgcctgttcatacatttttaataataacacagaacaggataaaaaatctcactcgatgatttggcacaccagcgtttgcagcactgaatgaaggaactttaagaatggaatttagtttttacttgtttgactccatttaagtcataagtgtcttcagaaagagcaccatggggaattctcatcttgcaagaaaaaaaagaatctccagaaggaaaaactccaaagctgtgtacaattgtgtctttgataaattgtctctaatccccaaaaataaagaatataaaaatttaaagaaaaaaataaagcattggagaaaaatgtggttctcaaacatgttttaaaaaacttatttgtttatttatttttgagacagtatgtcactctgtctctcaggctggagtgcagtcaaacacatttttatctcaactaaacaaacttcaagccagactttacagaatgccttaggaaaacaattgctgaaaaatttaaaggaaatcttgtgactatgactgctatagatgctggaagttttcagtagttaagggcaaagagtttttgagatttgacccaactgttaatcctaggagccaggttccttctggaaaacacaccactgaagcctttcttctggaattcagttggctgctctaggagcatcaggtgtcatgctgcggccagcaggaagtgggtaagtgcccaatacagggaccccaggagtctgctttgggcaccagagggccagctctgaaagtgaggatgaaaatggatcattacattataataacagttaggtttggagattgtaatactctgttttcaccctgctgataaagacataccaaagactgggcaatgtacaaaaggaggaggtttaatggacttacagttccacgtggctagggaggcctcacaatcatggtgcaaggtgaaagccatgtctcatatggcagcagacaagagaagagagcttgtgcagggaaacacctctttaaaaactatcagatcttgtgagacttattcactatcacgagaacagcacaggaaagacctgcccctattgtaattgaataattacctctcgctgagtccctgccacaacatgtgggaattcaagatgagatttgggtggggaaacagccaaaccatagcattctgccctctcccctcccaaatctcatgtcctcacatttcaaaatgaatcatgccttcccaacagtcccccaaagtcttaactcatttcagcattaactcaaaagtccacagtccaaagtctcatctgagacaaggcaagtcccttccacttatgagcctgtaaaatcaaaagcaaattagttacttcctagatacaatgggggtacaggcattgagtaaatacagctgttccaaatgaaagaaattggccaaaacaaaggggctacaggccccatgcaagcctgaaatccagcagggcagtcaaatcttaaaacttcaaaatgatctcctttgactccatgtctcatgtctaggtcatgctgatgcaagaggtgggctcccacggacttgggcagcttcactcttgtggctttgcaggatacagtttctctcctggctgctttcacaggctggtgttgagtgtctgcagcttttccaggtgcacagtgcaagccatcagtggatctaccattctggggtgtggaggatggtggtcctcttctcatagctccactaggtggtgccccagtagagactctgtgtgggggctctgaccccacatttcccttccatactgccctagcagagttatccatgagggccccactcctgcagcaaacttctgcctgggcatccaggcattttcatacatcctctgaaatctaggtggaggttcccaaacctcaattatttttttaagatggtgtcttgctctatcacccagcctggagtgcagtggcatgatcttggctcattgcaacctccaccttctgggttcaagtgattctccaacctcagcctcccgggtagctgggattacaggcttgcaccaccatgtccagctaacttttgtatttttagtagaaacaggttttctccatgttggccaggctggtctcgaactcctgacctcaacaccttggcctcccaaagtgttgggattataggtgtgagccaccatgcctggccccaaacctcaattcttgacttctgtgcactcgcaggctcaacaccacatggaagctctcaaggcttggggcttccaccctctgaagcaatagcctgagctgtactttggccccttttagtcacagctggagtggttggggcacagggcactaagtccctaggctgcacatagcagagggacccagggcctggcccacaaaaccattttttccttctagccctccaggcctgtgatgggaagggctgatgcaaaagtctctgaaacaccctggaagcattttccccattgtcttggtgattaacatttggcttcttgttacttatgcaaatttctgcagccagcttgaatttctcctcagaaaagggaattttcttttctatcacattgacaggctgcaaatttttctaatttttatgctctgtttcccttttaaaactgaaggcctttaatagcacccaagtcatatcttgaatgctttgctatttagaaatttcttccaccagataccttaaatcatctctctcaaattcaaagttccacaaatctctagggcaggggcaaaatgctgccagtctctttgctaaaacataacaagagtcacctttgctccagttcccaacaagttcctcatctccatctgagaccacctcagtctggatttcattgtccatataataattaccagcatttggatcaaagcaattcaacaagtctctagggagtttcaaactttcccacattttcctgtcctcttctgagcccttcaaaatttggaatccaacctctgccttttacccagttccaaagtcacttccacattgttctgtgcaggaaacgcgtgaagggagaagaaaagatacacacacaatacctttacgggtaaacaacctttatcccatgtaaatggcaatgcagatataataagcaagtgatataataataagcaaatgatatcataagcagattgatacaataagcaaattgcaatgggaaggggagaagggaatatatatatttacactcaccagattgtggaggattcaccaccagactgggaagcaacatcctgggctccagagttggccactcatctgtgcacagacaaagagaggtctcatgaagctttggtgcagtctgggaccctagctctttttgtaacgagttgtttggcatgaggcccagtcacgagggcccttcacgactgggctcaaggaacacaaaaaggtcaacttgtttttgcgattgtctattgtttttcaatgtataggaacagattgaaatggagatttctctgacacagcagtggatgaatgtctcaaggggctcacacaacctgttccgggacttggtgaccattgtttgtgtccatgttcaattgagttcaaatttaatatttaacttttcctccacacacattttcgggtatcttttcagcagtaccccactctactggcaccaacttagttttagtctgttttcatgctgccaataaagacattcccgagaccgggcaatttacaaaagaaggaggtttaatggacttacagttccacgtggctggggaggcctcacaatcgtggtggaatgtgaaaggcacatctcacatggcagcaaacaagagaagagagcttgtgcagggaaacgccccttttaaaaaccatcggatcttgtgagacttattcactatcctgagaacagcatgggaaagacctgcccccatggtaattgaattgaacctctcactgggtccttcccacaacatgtgggaattcaagacgagatttgggtggggacacagccaaaccataccagagataaatttcagaattattactgaatcttggaagttcattccccgatggtgaaatttgggctttggccttggtcattggcatttgttgcccttccaaagtgggcttggtgccctgaggcttcttgaggttcaggggcaacacccccaacctccaccatttggcccctcctatttggcagctcctgaccttggggaccttctgagccatggtggaggcctcatccatccccattctccaggcacctgccactcacctgctacctccaaccaggaggtcagcacctttgtgcagtggccacccagaggcctgggagggactttgatctggagggtctcctgctgtcaggccttgcctagggctccgcaccctccctccagcccttgagccctccaccttcctcaggtggggacctccccatgtctctctcttcaggtgtgtaaagcccgaggacaccctggggagttggggagtggagggccccttgctgcccaggtccccaggcccctccaacctgcatgagctgcagaatcctccaagtgcaccagttccccagctctgtgtatttgcctgccagttccttgtctgcctccctgagctgctctgccaggttcagcagcatcatggacaatgccatgggctctgtggctggggccccctggagctggggctggcccagtcctgatgagtcctcccacacccgtggacgatctgatccatcatctccaccacttccatctgggggtgcaggaggtgaggggaggcccaggcttaggctacattctgtcccacttgtcccatccccaaggacatggccctgggtgggagagctgattcctctcatgaattccaaagacatcttcatccagggccccagtgtctggtggggtccagggagatctgccccaccttacctagggggctccatgtctggggttgcagcccctcccaggctgtggggtcagggtctggcagcacagggagcccagggaggagggaggggcctcttcccggttgggggcagggtgtggttagggccctctctgtctgggcccctgtggcatccagcaggtgggtgttcaaaggtgaaggagacttctgtgggggaagggagacacctgtagacaccaatgacaaacagctcaataaggggtggtggtgccagaagcccttggactgtagaggcccagaggaaacacctcaggactgcagaatttgcgatagggaagaaagggatgaacagacttaaacttgtggggtaagctggcttgttggaggagatggggcagaggactgggatggacagagaaccagcagcacagtatcccaggagtgacgtagcccagccagctcacagcaccctgaggtgctggccccacccacctctgaaagtgctgaggtgacaggccgaccttacagtaaagaactctctgtagcacggtggggcctgctgggctcgggtgaggaccacccctttggagctgccttcctcccccagaggtcgacaggtgcagagaggaacatggattgggtccagaaaggcaaggcaaggcaaagagacagggatgccagtgaggctgatggaacggggctggggcagggatggagaggtgccagagaggaatgtattaataaaaccccatagcatctgaggagggagtggggggatttatccactaatgttgtatgcatttggcttggtagttgttgtgtaacctgcctccactcaagtgcacaaatcctacccaggagcacagcttggtgaacatttacataggccccacttgtggtgacattttggctgcatgtctgtttctctctggcactctgtccttgagggcagggaccttgtcacttgcttttacatctctggggcccagcacagagcaggtgctcaataaatacttgttgaataaaggtcagaaaagggatgacagagcagagagtttttctgacacatcttgcccgaaaaagatttcaggccatgtttttattatgcagtgagcttttgaatgaaatgcattttagccgagaaggtgcatcacatctactggagactagtgagggtggacaaagacacagctctggaagcttcaggaaaataagctgggagagtattggggaggagaagctaaaatgcagtgggcatggaagcagaagcccccatttctacctgttggcctgtccttcctgtaatgagaggtaggctggggcggagggctgtgatggggaatttgggctagaggaatcagggctgcagacactggcccagagattaggggtttgggactgtgaatctcaggccagcaagagacttctagggtgtagcatgtgatctttccactaatcttggattttttaatgttccaccagggaggagagccaaaaggcacatcccgtttcctcagatgccttctcgtttgttctatagagggtggtgttggaagagctacagtgctcaggcaggcaggggaactaggagaggggcaggagagaatattctcaatcctctactaggggctcataggattcccagagaaaaccccatgctgtcccctcctgccttgggtgcagtgtcagctgtccaaatggacccatgcacatctgagacttgccagaacagcttgcacacgttttaagaaaaaacaaacaggtagaattctcagtaacaagcacataatgatgcttttccagcaactaagtgacttgcaagcggcaagggctgggccaggccggggcaggcattggctgggggtggacgcaccgggaggtggctgccttgctaagtaggaagcaaccgtcaaggggggtggtatcgctccacccacccagagctgcacctggggtaggagaatcgacagctgtgatgagcatgggcccctgccagaagccagggagactggggcagtggagagagtcatgttgtctcctcctgttggctcccatcgggatgtgcatcccggagccggagggatgggatgtccttctgcagttgggctgctggctccacggctgagccgttggcatttagaagggccaggaaactggggcctgctcctgcccctgacttctctgaggcagtggtcaccaggcagagggccagccacaggccaccaagaggaccgaactcctgctcccacccctatgcagcctagggatgattctcaagtcccaaagccatgttatcccattcccagtccctgagggaggagctgaggatctggccttgtcttctgctcccacctggaattccgatttggggagccctagctgcggtgaggggaggctgagtgaaagacccctttctgccaagggagagctcagagttccaggcaaaccagcctccccatcagggtgcttcctcttccctccaagtgcccagcaagcactggaataacattcccagcaggggccacaacagcacctggaccccaggagggggcagtttccaagtgcaaggacaagtatagaaccccatggcatggagaaaggagcaaggaaagtggtaaatgaaggtttgacaaaagacgtcaaggaagaccaatgccatttaacatatatttattgaaatctacttgatgcaaggcactgtgctagatttggtaggggatcagacatgaaaggccacccctgtcttctaagagctcacaatttaatgggtgggggagggctgaggaggagggggtgaagccaagtccacaaacagctctagtgcaaggctgattatagtgagtgccagaaaacagacaaggtaatgagatgggggaatgagaaaaaagtgccaacaaccaacggaaatacaaactggggtgggacatagctattgttctcagagatacgcaaatgacattgagggccaagtttaaagagacagtttctgcttttcaaagtaaacatccaaagtgatgcaatgagaactacagaatgtaagtacatgagtaagagagaagttagcaatccccccatctgatggacatgctggaaatcgtgaaacacttcaaaaataagagaacagggtgcactgtgatttcactcattttatggcccgcatgtggtgggttcagtaaaggaacaatatacgtagacataaaatcacaggttaaattcactgagactagaaggcatcgactttcacccatcttagagaacagagaacacacgtttgaacaggtgttcatgcagtcaggtgcgacttggccaggaagcagccaagtggcaaaacacaatagaaaagagtagagacccactcaagctggctcaagtcaaggagtctgtagtggggacgcacgtggaccaatgagggctgctgccagaaatccaagaacataccatggccaggccttcctcccagcaggcgccacgctcctcactcctctgagtactgtgctgctccccacaccttctgatgcctagaagcttctgtttccttgtttgcatttcagatctggaaggcctggtggtgtccgtggtccatcatgttctgtcagctctatgctctgatgattgcttgctgcccttgggtcaggtgttcagttctggctgaattaatatggcctagaagcggggtggcaaatcacatggtacgcaacagggccacaacccagggctgcaggtagggcaggcgctgtgccagttctaggacaaaatcaagcacatggaatgcaacaccactcaaaaacatgcccgctgcaattgggtagggactattctggaaatgcaagagtggggtgacacagctaatggacacagctcatcgtaataagcagcaaaaatggtaatcaattactttcttttgaaaattttcacaagtattcaaaactctaataaaagcaatggaggatttttttcaaatggtaggaaaagaacatatttcttttttttttttctttttccatgccaggcagttaatgtgctgacatagtaacaaggtttgaaggaggaacatctcatgcacgtgcgtggaaacccaattgtcatgtgtatgaactacaaaaggatcgggaaaagaacacatttcctcacaacaggaatacatgagattagaaagaaaaccggaatgaggtagatgcatgaatgcacagacaaggatatgtgacaggaagctgggtgacattttgcatctgacatagcagtacacctagagagcccaaggaaatccacccccaagttaccagaggcaagaaatgatcttggcgaaattacaggacacacgttaaagccacagactgcattgaaagagaacacgggtttcaccgcaaacaccatgaacagctgttctgtcaaccttgacggcaaagaccagatctttagtgttaactctaaaagagcatttgtttgggagaaaattatagaactgaagatgggaaagagtcaaggacggcaggaagggatgccaagacaccacgtcccagctgggagcagtgacgactttatgctacgttctgagttaatgctgcattcaatgggatcccttcataaaagggatctacttcaatgggatccctcatgaaacccaacaaacgataaatgaacgggcaagacatggcagagtacttctaggtaaaggtgccagacttgcccctggtagaggtcaaccttctttatcaaatgacagctgtacaaaacacatcctaacaactcgaaaagagaaaaaggatccgagaagaaagtagtgatttcagacacagattcacaactactgcaagaactgaggcccacagggcaaaaggaatcactatgtaacaagtgcttttggctcctctccagcctgggggtcaggatgggtgcctgagaagcccttccaagttgtgtctgctaggaagctctgcctcagccttggtgggcccacgagaagggcacacttccttgccaggccctcctagtgtccctgtccccagccacagctgctgggaagtcacagcacagccctggtggggctggcttctatctgtggcttctgtgggccactggaggggcaggttcctcgctagcccttgctgctgttcctcttgggggagcccactggaaatggtagctcagacccaggaggaccagcttctacttctatgccacacaggctttcagaagggttccactgccctccaaacctttgctttagtgctcctcctgggcatggctgttgcaaatcatagcccagggcagtgctgccagcttctatcagcataacgcacaagccatcggaggggcagggttcctctccgagcctctgctctgttgccctcacttaggtgtggctataggaagtgatgccagaacacatgggtgaattttcccctagctgcccacagcagaagcctatgaaccaatctctttctagttctagagtcaccggctgaaaggaggatgtggtctaggcaagtcttcttgtgtccaaggagatgtttcttgggtgaatctgctgctcagtcactgaatccactcggagcattgccaaggctcccaggagctcaaaggatggctgggctgcttgctcccagaccaagtttggaccactccattgatctaggtgaggccaagccccactgctgctggcggggtctataatgatgagcagtcacagagttctggctaatctatgatgggagcatctccagtgtgccgcagtggtcaggttggatagtcaagtggtgcccacagatagacagggagtccgcatctcggatgaggaaagagcctgcttctctggcccatttccatccagcctgcccacctggtgtactcaccttctgatgggctggggttgcagctttttgtttgtaattaaaattctagagaaaatgtcatcatatctagctacagaagcaatgaaagttatgactgagtggacaaaaaatgaatgcttggatatgtaaaaattaaaagctttcacaacaaaaacgtaataaaactgctacaaaaagcaaagcaataaaattggaaaagagaacatcaccatcaatatagaaagaactgctacataaagttaatatatccgaaggtaagttgataactagtcaaaggagatgaacggaccatttgcatgcaaaaaacagaaacaccatttaagtcatcgcataagagaaagatgagactggtggtcaggaggcctggggtctatccccagttctggaattgacaagccacagaatgacggcaataactatgacaatgacaatgacagcagatggccttcactgagtgtgtacctccataccaggccggtggtcctggcactctgcagccacgatggcagtcctcgtgataaccttcggaggtaggtgctgtgatcacccctgttttatagaacaagaaacggaaggctggagaagtaccatctaggcctgataccaggagaggctcatttccaaaaggaggcgtcaccctgcacttgagtccttgagatgtatctcttcttaggggcatgctctcaactattttattttgaacaaaatagtgctgcttgaggacaagacccattagttcaaaacaaccccaatcgatgctagttttggatatgtataggggacaccaaattgaaatggtttaagaaaaaaagataccgacatttaacccagattcagtaactgttactaggcgtttggcctcacaatgacattttgggtgctttaaaagaaaagacgtttaaaggttgtttgaaaaagtatgaccttaagtggttatattgtacagtcacaggacagattaaaaaacgacaagagaaatcgtcctaatgttctgcaaatatggtcttatggcttgggagaaaatttctaatgagagcctcatgaagggatcgtcactgagcgaccgtgcagagctcggatggaagtgactgggtgtgtcttgaaactgtctgatgactcaaacagggttcccatgttggtgaagacggtgaggagtcagagtaaaatgatttcgtgaaagggagggtggcaaaaatggggtattttctaaattaatatattattttatataatatgtgatttacagtatgtatgtataactaaattaataaattaaatattttaagacatttgagtgttctatttacatccctaaaaatttataaattcaagtaggccaaaaatcatgagggcaacgttctcttcaggaaagctgggatcacattatgaggacgccatcgtggaacagctctgtgtgtttctctggggcggggggagcttggagttgatgacctctaagcccctccctaccccacatccagatttgtcctctctcattcttggattcaaggcatgtggactgaaataccttgatggtacttcctaccagttaaactagccaaactaagttaaatggtacaagctactcttgatgggcataacgtaacacttataaattgctggtggcagtataaatcggtctcaaccttttggaagacaaaatatataagcgctacaaaactgttcatctcctttgactctgccatcccctctggggactccgtccctgtcccgcgggaccacagggcgtttctactcgtggtgggttggctgatgcttctgcagtgccgagcgcctcttgaacacgcggccacactggctgcattcgcagcgccgcgccccactgtggatccgccggtggcgactgaggccggagctccggcggaaggccttgccgcatttgtcgcactcatagggtttcagtccgctgtggatgcgccggtgcttgatgaggtcagagggcccacggaaggccttgccacactcgccgcatgcgtagggccgctcgccactgtggatgcgtgcgtgctccaggaggctggagctctggcggaaggccttgccgcactggccgcaggcgtagggcttctcgcccgtgtggatccgccggtgcttggtgagctccgagctccttcggaagagcttgccgcagtggggacacccgtatggcttggccccactgtggatgcgctggtgctcggccagcccgttgacccctcggaaggacttgccgcagtcgtcgcagtcgaagggcaggtggccagtgtgcatgcgctggtgcttgagaagctcctggcgatccaggaaatccctgctgcacgccttgcaggcgaaaggcttttccgaagtgtgaagtttctgatgtcggaagaggtgggtgttgactttgaacgaccgcccgcattcctcgcaatcaaagggcttctctctgctgtggaccctcagatgctgactcaggcctgcattcttcttaaaccgttttccgcactcctcgcactcgaagggctttgcctccctctccatctgctccctcttctccgcggcattctccagggccctactggggccgggctggggctccgcagctacgtggcttttcctgtgctcattaaactccgccacccccctaaagaccttcccgcagtcgccacattcccagcccttctcctcactgtggactctctggtgctggacaagcaggactttaagccgaaaggtgtccccacactctttacaagcaaaatgatgttctatgggcagattctgtgggctccctctcttcccgtcagagtccccgtgctgtctgaattcaggactgggaccactggcccttgggaagcttgtggacgccatctcctgtggctgggcatcttcccccttcatctggtgtcgggtcgcggaggtgctttctgaaacgataaacacaaggcagtgtagtctgcagaggatgaaggagggaagggcctctcctttgtcaagaatctttttctttctgagacagccactgagcacggggcctgggcccggaagccaccagaagcaaggactgcagaagccaggggcagagggacctcattctggacactctctaccacagtggtgctgaggaggtcaccccttctgtgaccagagagcagccacacacgtccccaaaggctcagctgggtcccccaaccctaacctcaaccccaagagctcagctgggatccccaaacataacttgaatctccaaagggccctgctgatcctcaacctaacctcaccatcaagagctcagctggggccccaaaccctaactagaactccaaaagctcagctgggacccccaaccctaactgtaactccaagagctcagctgggatctccaaacataacccgaatctccaaagggccctgctgatcctctcaaccctaacctcaccgtcaagagctcagctggggccccaaacactaactagaaccccaaaagctcagctgagccctcccaaccttaacttcaactccaagagctcagctgggccccccaaccctaacttcaaccccaagaactcagcagggctcccaaacttaacctcaaccccaagagctcagctggggtcctaactttaacctgaatgcccagagagcccagctgatcctctcaatcctaacctcaaccccaggagcccaaatgggcccctctactcgtaacctcaacctcagaagttcagctggaccccctaaccctaacctcaaccccaagagctcagctgggtccctcaaccctaacccgaacccaagagctcagctggaaccccccaactctaactcaaaacctccaagaggccagctgatcctctcaaccctaacctcaaccccaagagctcagctgggcccccaaccctaacccaaacccctgagagatcagctgtttctctcaaccctaacctcaagcccaagagctcagcagggcccccaaaccctaacctcaactccaagagctcagctgggacccccaaccctaacctgaagcctaacagctcagctgggctctccaaccctaacccatgccccatagcagcttggttgggtctcccccaatttcctcacatttctttttcactcaccagagtacttagcaggatcagtgttgggcgatgggtctgacaccagtagcacttgtccttgtgccaggtgagggaccaaggcaggatttaaaacaggaacgcctgctcatgggaaaggagattggttatggcaacagccagagatgacatgagaatagtggaggaacataggcaaggcctttgaaggggaacccccttcaatcttcaaagaccaggctttaggcaagtcattcattcagttcaaaggtgtttcccaaggtcaggctccttccaggagcttgaggaaggcagcctctgggcccaccttggggaggctctgtggagtatcaagtggccaccctgaggaggtgatcttcaccctgtcttctctctgtccacccactcagagctcacacatttaacttcatgctcttcccagacacgtggacttcgacagctcccaaatctgactcccaacgtctctcctcctaaaacctcctccccactgcacacatgcagacccctaatgggtgaacaagatcttgatcacgtcaacctttctcacaaataaactcaaaccaaatggccatgcaatttgcataatttgtgcattaaaatgaaaagggcattctacattacagtggcagtgttctaatttctttcccagtaaaagactgagaggggttctttccatgccaagaggagttgggggagctcatactactctgacatatcaggtgtggcagacccattgtgtttccccacaacccagggagaaggtgagcttctgtgggggtagccatgtgtcccctgccccactccaagaaggtggtgaatttgaggaagggctgggacatccttacccacagaggtcacgttcccataatattccagtgccctctgttcagggtccagcttaaaccactcccttgtggtgaggtaccatgccacatcatcaaatgtcaccaaatcctgaaagaattcccagggctcatcagtctttccatctattttagaatgaggcaggggcagcgccagtaatgccagggtcaagaggtgagggtctggagtgggtgtctgttgctaacatggaggcctaaccacagctccaagaagtcctgaaaagagaacctgatcaagcactaggatccctgggccatggacctggcctctcgtctttccaagggacctccattcaatcactttcctggatggaaactcagcttccccacctggatgattggaactccaagcccagtggacatccaatccttggcagcctccagaagagaagcagagggagggtaggaaggcagcagctggggttcatactctgccgtgtgtcatgctggggcaagagacagaggctgaggccagattcagggagcggtgagagaatcccaagcaaggcagagggaagcacagctcacctaggcctctggcatctcaagagggactgccaggacctggtttcctggggctccatcctggggagggtaagaccttggggagtaggtggaactaaagaaagtgaaaaaggccatgagtgacgacagccctgtccctggatcccctgggaagagactggtgatttcttcttccttggtttctgatcttgttgagtcttctctcacatgctggctgaatgacaagccagggcacggagatgcctgagaaaacacatcttgaacaatggggaaagtagcctggcaaagaatgaacagaggcaggccagagggagccaagacaagaccagcagatgccagcccaggcacagctaggagaagacagacctagacagaaagccaagggcagggagactggcaagcctagaagtccatgctgatgctgcacaggaaggaggcacaccaagatcatcagaagaaataaccaggaaatgagagaccctttccaactttgtagaggcaacaaaaaaccggatgaagatgctggagggaagagagcaggaatgggggcttctagaccagcagtgaggcccttaaaagccacagcccactgacacaaggagcccggtgacagcaagacaggtacacatgacagcagttctctaacgtgttcaacccaaatgaaaagtggaacaaaacagctggaaaaataagcctcaaagaaaagatcttcaaacactaaattgttaaataaaagagctgaatgatttgtacaaattatcttcttcttccaaattgcaaaatatgtgaaagattcaaccaccggcatccgtgcatcacaggcctcccacttcagtgaattctaagaaacagctacacagttcctgttgtgatgacaattcaattcaattcaactcataattcagtgaaaaggaaggctcttacactggctcaaggcccacaaaatccagctactccagaaagactcttatataaaattaaagatgttatgtgaaaaagaatggacagaaacttccacgtttggctgcgatggagtaacaaggaacagatttcacatcgtgccataaataagtagaaaaaaatggagaaaatatatgtgaaacaagttttcagacactggacagcaggaagcacagaatcatgatccccaagagaagagaaacagatgacgggagccctatcattgccccagctctctgcctggaggcaatttccagatcgagactgtgtgttggggtgggcgagaaccaaatagagcttagtggcttcgccaagttgaggagacacaggccagcattcagagcagctgaggcagctggaagttgcagagcagagttccagaaaggagttagttatgcagtaaaaagagcttcaaaaaatctgtataagcctccccttgagtctttcctgactactaggcccatgcatgcatagagtgaaactccaaaagcccaggaaaagggtgaccaggaagctgtaagctgaacaattctcaggacacacaaaggtagggagacattcaaggtctgatcaaccagtatagagagtcctctgtgatcacctgggacatgcagcagagaatccagaggccttagtagtagggctgatctattcctagagccaaagctacaaaagacctgtctcaaagaaagcttaaaaataggcctcaaagggatcatactgatccacaagtaactaccaccccaaatccagacactcaataatataatctttataatacccaacatccaatcagaagttactgaaacgccaaaaagcacagaaatgtggccaggacaaggagaataatcagttaataaaaacacacagaaatgaccagtgatgactcacagacaaggataacagcgagtttaatgatgtacaagcattaaaagaaaaacaggaatatagtgagagaaatagaagatataaaaagaaccaaatggaacttctggaggtgggaactatgatatttaaagtgaaaattttactagatgtgattaacagcagattagataccacacaagaaaattagagaacttgatgacatagcaatagaaatgatctcaaatgaagctcagagagaaaaagagtttttaaaaacaaacagcatcttaatgacctggggtaagagaaagtggtctaacacctacataactggaacctgagaaggtgaggaaaagtggggggagggatgaaaaatacagttgaagaaataatggcaggacagttttccaaatttgatgaaaactgtaagctcacacgtccaagaaagtcaatcaacccctagcaagactttaaaagacccataataatcagactgctgtaaaaccagtgataaagagaaagtcttcaaatagccagaggaaagaaatgatgttgctgcgtggagaggagcaaagagtaattactaacttcttatcagagaatgtgcaagtcagaaaaccagtgcatgacatttttaaagtgctaaaagaaaaacaaaactgtcaacttagaattctatattcaaggaaaatttccttccaaaatgaaggcaaaataaagtttgttttcagacaaaagctaagagaattcatcaccagcagatctctattataggaaatactaaaggaaatctttcgggttgaaggaaaatgatagtaggtggaaagatggatctacacaaaggcatgaagaacaccaggaatgtaaatatgtggggaaatatacaatgcttttacccacctcacttttaaatcttttaaaaaacaattaatcatttaaagcaaaagtaataaaaaggtagtgtggggtttataacatcagaagtaaaacatatgattgtgtgttctgacaagtcctccaagactctgatacatgctaataagccaacagcagagatcaaatatgtactaaaaataatctgaaagaagaaaggtaaagaaaaagaggggaaaaaagaatggaagaggcaaataaaaacaaatagcaagatggtaaacttaaacccaaccacgtggatagttaaggtaagtgtaaatggactaaacacttcgatcaaaaggcagagattgtcaggctgtaataaaaacaagacatactgtctacaagaaactttaaatataaagacacagataagttaaaagtaaacagatggagaatggaaaacatgatactagaaccaacagaaagagtctaaaaaatcccaatgtcataaaaaagtgggggaaagaatgaatgacagatgtggctaagagctctggagacactaccagagtcctagaactcagcaggaagaaaactggagggtttcaatataaaaccaacaggtgccaacgtaggatgatgtgctgcagatgacaaaaatgtgaatccttcgtagatgatacaggcagacatagttacttctcccttgaaaacctaaagagggtaagggaaggggaggggaggagatggctaagtatatatttgcattttaggagaaaaaaggaaaaaagtgagagtgacttgtagctagaataagcacatctctaatgtgtatgtgaccacatggggttggagttggggagagtcaaggtctagaaagatctgctttctttttctgtaatgtgagaatttttagtaaccaagctgaattttcttggtatcagaaaagcataacaattgtaaaatattttgcttttaaaagactttgagtaagaaagctgctcagcatgtgagaagccaagggctgaggccaaggagtcaatggggagcagcccttctgcttgggtaaaaaacccagcatttcctgggatccctacacagcaaggcaagtgcaggggagaagggctggcaggaatctatgggcggtccatgaagggaaatgaccagaaagcctagagacaggcccctggggttgtgacttcctgggctcctccctgcaagctatcagcacctaagaagtgcgggcagaaggcctcatctagccccagagtccaaggcagccccattcccatctttaactggctgtctggcacaggggcttccccagtgtgagatcgtgttcatcctcgggtgctcagcagccacaccctctctgtcccactgtcacccgggcagggccctgctggtccgttggattcctctggtatacattcgatgtctgatttgactttggcttccagtacaaaatgaactggtcatgaattacttacacaattcatttaaaaaaattcacttccaattgacattgacgtttggctgccaaacagaatgtagagggggatattgtggatacaccttctgagaaagaggacctgttagagacctcttctcgctgacctcaggccagagacctaagaacttagccttctgacaatgccctggcccagccccccaattccttatcttgccctgccacatcgcagtgacatccagacacactggccttcattcaatcctcgataggccaagactgtggccttcaaggcctctgaaactgctgagaataccatgggcttctcatggatggctccttctgagaattcaggccccaactctatttttatttttctgagacagggtctcactctgtcacccaggctggagtgtagtggtgccatcacagctcactgcagcctcaacctcccaagcttgtgaacctcccgcctcagcctcctgagtagctgggactacagctgcgtgccaccatgcccagctaatattttaacttaaaaaaaaaattgtagagatggagtctcactatgctgcctagactgtctcgaacttctgggctcaagccatcttcccacctcaatctccgaatgctgagactacaggtgtgagccactgcgcctggcccacatcaggcctcaactctaatgtcacctccttagaatgccttcactctctagtccccgtcatagtctacttggaacacttttgctaactaaaaactatccaatgaaattgcttgtttctaactgacagtgcccaggagatatggagctccaacagcgcaggggcactttctcattcttggtcactcctgagtccccagtgtctgcagcagctcctggccctgagtgggtacgtgataaattgcggggtgactgaatcaatgtgtgtggggaggggcatgttaaatggagcacacttccatccctggagcatgcactacacgtgtttggagacatgcatctcccttcctgtaattcacttaccacatcctgcggttattaccgcctccattcacagagaaggaaaccagggctccaagaggtaaacttgcttaatatctagctcccaagatttgagacttttcaaaccacaccagagaagagtgaaataatatccaacctataacaccacgccacagccagaagacagactgggggtgaggcttagtgtcatctaggcctaatggtatatatgggtgtttgggtgctgcctttaaaccatcctgttaacatgccctcactgcacaacgagacatgccattcctctctctctttcttcgtctctctctgtctcttacacacacacacacacacacacacacacacacacacacacacacacacacacacacagtcctcccaagccacccacatttaattgagtgaatcctcctgaagtgttcaacttaatcgggcaaatcctactgaagtgtttttacttaattggcatgattaactgttgaaatcctggagccacaacccccaaatgaattgttaataatcctttcctgtgcagcaacaggagtgccccttcctgtagcagctcatgcaggggacttagcctgagagtactttagctctcagtggctgcgtgatcaccacccacagtgacagagccctggacacggagatcatttaaaaggtactcataaaaatgggaggaaagaagtgggccctgcttccacaaaaggaaacgaaactctgcataattaatcaatcaagtatatcaggtaaaagagctgcatgagaagcaaaggaagatcattaaaaaaagataacacattaatccctactgcagttcaaaataaaattatcatcaatcctagagacaatcggatcatttagggtccatgttgcacaactcttctattttaaaatggtggaactaatcaggaaaagaagctggatgctgtgacaaaagtgacaaacgcaggtgtccactgccttctgacagtggatcttggggaatcaaggtcgaaggaattccagacagaacatgaaaatcattgtaatgcacacccaatggacacacagggtaatgctgaccctgaagtgaggcactttcactcacagcacaaaagcatgtcctgaatctcatagggtgcactcctacatacaactgggaaatatgaaagctcaaagaaatactgtggaaaaacacatttccaacccttaacgtaagtggtattactctccttctttcaatgggatctgaagatagtctaaagactataaactcccagaaagcaaaggccctgtcaaggtcagctgtgaattgcacactggacctaggcaagcaccattacactgcagctgtttaacaaacatctgctagaataaatggaaaatagtgatgtcaatgtcaacctactgcctgataatttgaaaaattatgctttctaaaacatgaaagctcatgtgagtgaacaaatcttcctgctaacgtgctttagatcacaatgtaaattttaaccaacttatttaaatcaaatttactgcatggaaacagaaaacactaagagtctcaaaataatcattccactttgatgtggaagaacagaaatgaagagttgaactcaacagagacaaaaaacaacccacgtcacaaaatgtagtaataatgagatgttttctggttgcctttggattaagaacatccctgcctcactgctggatgtttggctactggctaacggtagcttctgagcctaaagaccagcgttcaactgattttatcgcacaaatagccaagcaacattctctaacaggtgcgctgtccttccctgggcaggggaaaggcagcaagaccacccaaataaggctcctctggaaggttccagaagcttccaaggggtgccagaaacacctggactctctgaagcatctaaataaagacctggagcagaatgtcctcaggccctaaagcttgagtttacccagaagacaacaggtggcttgtgttctgctcagttctaggccagagcaacgggtgtcttcaaaggtttccactcacaaaagatccaattcagatggatgccttcagctccctctcccatccaaaagggagattagactccagattctctttcctgaatatcttttctcctgtgagttgtattgcttggattgagagaactgtctctgggcaaagacagttcagcaacagtggcacagatgaaaatataagtgcttccggaaccaaaacgatactcctcaccatgttgtaaccccacctatagggtcttctgatagcatgcccagcgtcaaagccagcagacaccatgcataaacacccagacttacccaaaagagacacacacggatgactcatcatgcctcagaactactccaagggatcagcctggcaggtaaggccccatctgttggattgcaataattcaggtgaacagaagcagacctgtgtgcacctcccaggaacatgtcccccacattttgggggatgtactgaactgggccagatacagggttcaactgaatatatactgccacgatctggatccaccctagccaggccaggatgcaacccttgagccaagccctgggccacgctgagcctggccttcatgttctttccacctgacaggccaggaggcggaagtgaaggccccacgtgggcccatcccgtcccgtcccaaagcagcaaacaggctgctactcgaagtagcagaatcctgaagggcctaaagagagggtgtctcaccaggaaagtctgtctctcttggggtatttgtgtctgtgtgtgcctttttctgtatgtgtgggtgggaaggcatctgtttcctctcactttgcctgggcacctgtctctttctgtttgggtttctatcttatttcctttctataaaaagccagaaggtagaccagaaggggattttgtagtgtttgttgtacttaattgaggaaagctttgtgttcccatttctccaagaagattcatggcatcttactaaaaatcgaaataaattttaagtatagcttcctttaggtaacatcgcctggatacaaaggtcgaaattgggggtggggtgggatgctatgcaaattgcaaagagcccagggccatccaaggagcccaggcaggtttgggtaagggctggatcactgggtgagaaagttggtgtggagttcactaagaactcatgtgggagtttcgcaggtttgggagagaccaaggagtctgcatttttcaacaagcaccccaggagattatgatgcagagctgcacctccttaacactgggcctgtctagaatctggaggttcccagattctccaactctcagaatctctgttactgacaggattcctgcccaggaacctgctgaaatgggagcccactatctctgagtctgtgctgatggttagaagagaattcacaagttctggtagatttccaaggggtccctcacagacagaaggctgcaaattactgctcaatagggttctatatataaaactcagtgtctgacccagttcagtacatccccctagtaacattttgtggggatgtactgaactgggccagatactgtgcaagtggcttctacttgaaggtccaatgttgcagggttgggggaaggtgagggtggggaggggctgaggcagcattagtacctaggggaggtgctgttccagcaatcccatctgaaattctcttgtaaaggaaaaatgtcgggctgaggttgaagaggaaatgtttcattgactaaggagactggagggggccgcatgcccagctaggtcaaggctggctggagggcttcagttggaacaaggtggcagggtgggacctctgggaagtgggccaggaatgggggcagggggttgtttgaaagggaccatggactttgggcggcaggcgagtggggggtgtgtgtggaaaagatatataattaatcacccaaatatagactggaggagccagcaaaggagtttaagggggcgggggcactgaagtgggagatggcggcccccagtagggcgacagaaaaagactggttcagacagagggccttgagctcggctcaccgccccctttcccctgcctctccacagctctctctctaggctacctaccggcccccattctccccaccaagctgaggcttaaccgcccccccccactcccacccactcaaaaggaaaggagggactccccagcgggaactgttcccacctggcccaccctcccagctcccagactgcggctcagtccctcccctagaccagggaaaagtcctttaacccccacccctacaatgccccctccagatcgggctcctaggagctaggggcaggggtcctttctctccgcccctgagcggttcccatctcctagcgtcccccaaagagcagagcaggcctctacactttagcgattcccacccgggatcgccgccccccgcccgcctcgggaaggccttcgggcctcttcgtactcgtcatccgggacccgttccctgctctggcccgcccaaggccgagcagctctccaactgcccagagacgccccctccctccaccgtgcactcttctgcggcccgcacactcgctccagccccgcacacagtcctgcaccccctgcacatcctctcgcggccctgcacgctcactcaggtccacacgtcctcctgccgcccccacgatcacctccgccctgcggcccctccagcgccccccgcacatcctcccgcggcccgcacactcacccaggcccggcggcggccgacgcgcggccctcggtggagcggcgctggcgcggcccaggcaggcctggcgtggcaggaagcgccacggagccgcccgtgcccagccgagctaacagccccgcggcgcgtttccggagccgtgagcgccgccgggggttctgagggagcgaggccccgccccggccccagtctcgtccccgattggcccgggaagggggcgtggcgggaagggggcggggtttgggcgggggcggactgggcaggcaagtctgatcagcctgcgggggagcggcgcgcgcgggctggacgcttgggtggaggtggggaggagtggaatgagcgtgcgaatgaatgaatgaacgagcgaacaaatcgaccagcagacgaaggaaggaacgaaggaatggaagggacctctcccccttgggcatcttcaagatggtggtggggggagtgaagggtcgggaactgagggcgaagactggaaagccagtattctgtatgaatggaatcagatcgtatgtactattgtgtgtctggattctttcattcaacgtgatgttttcaagatttatctatgttgttgaatgtgctatcgctgagtagtatgctattgtttggatatatcagagttggtttgttcattcaccaggttatgatctgggctgtttccagtttgggcgattataaataaagctactatgaatattcatgtacacatctttgtgtggacatatgctttcatttttcttgggcaaatacctaagagatgaattgccacatcacaggatagttttatgttttataagaaactgccagaatgtattccaaagtggttgtgcaatttacattcccaccagaaatgtatgcgagctccttttctttcccatcctcatcaacatttgaggttgtcagcctttatttttagccatttgaaagggtgggaagtggcatctcattgttatttcaattatcatctccctgatgactaattatgttgagtatgcttttatgtgctcactggccatttctatatctttctttgtaaagtgtctgttcaagtagtttgcccaatgttatgtgcagtatatatatatgtatatatatgtgtgtgtgtatatatagagagagagacaaaagagaaagctagcccattatgtgcaatgtgtgtgtatatatgtgtgtgtgtatgtatgtatatatatatacacacacatgtagttcctgagaaattttatgttttcaactttcattttagatttagggggtacatgtgcaggtttgttgcctgggtatagtgtgtgatgttgaggtttggggtacgaatgaccctgtcatccaagtactgaacatagtacacaatagttagtttttaaacccttgacccctccttccctgacccctcttgtagttcccattgtttgttgttcccatctttatgcgcacgagtacccgatgtttagctcccacttataaatgagaatgtgtggcatttggttttatgttcctgcattaattcacttaggataacagcctctagctgcatccatgttgctgcaaaggacatgatttcattctttttttatggctgcatagcattctgtggtgaatgcctaccacattttctttatccaatccaccactgatgatcacctaggttgattccacgtctttgctattgtgaatagtgctgtgatgaccatacaggtgcatgtgtcttggtggtagaatgatttattttcctttgagtatatacccagtactgggattgctgggtcaaatggtagctctgttataagttgtttgagaaatctccaaactgctttccacagtggctgaaataatttacattcccatcagcagtgtataagtatccccttttctccacagtctctccagcatctcttattttttgacttttaaataatggccattctcactggagtgagatagtgtcccattgtggttttgatttgcatttctctgatgattagtgatgagagcatttttttcatatgttttttggccacttgtatgtcttcttttgagaagtgtctgttcacgtcttttgcccattttttgatggggttatattctggatattagacctttgtcaggtgattttctcccattctgtaggttgtctgtttacactgagatatatttgacagacaataaactgtgaatttgtcatgtttcagctaaacaacttgataagctttcacacacacacacacacacacacacacacacacacacgtatgaaaccatcaccacaatcaaggcaataaggatttccatcaccttcaaagtttcctcatgcccatgactatccctttctcttctcctctcctgtccccaggcaaccaatgatctgctttctgtcactatagggtattttctagaattttatataataaaatgttataataagtcttcttttgtgtttggttcctttcactcaacaaaattatttggaaattgtcttagtccatttgcactgccatgaaaaaatgcctgagactggatgttgtggtttgaatgtatcccttccaaaattcaggtgttgccaatgtgatattattaagaggtgaggcattgtcattgtctactttatatagtattaaatggacagaaggaagaagagggagagacccagatctattaaaaggtgattagaccagagggctactccctcggaatggaattaaggcccttataaaagaggcttcatgcagcatctggttagcttgctgttttgcgtctgccttccaccatatgaggacatggtaagaaggccctcaccacacaccaaactctgagatgatcattagcatttttagcaataaaatattttaaaattaagatgagtacattttttttcagacataatactactgtacacttaacaggctatagcttttgtatgcactgggaaaccaaaaaatttgggtaactggcttattgtgatatatgctttattgccctggtctggaacagaaggcatactatctcagaggtatgcctgtatctatttctttttgactgagctttgctatttgtatctttcaagaaatttgcccatttcatgtaagtagccaaatttattaatataaaattgtacacaatgttctattattatctgcagtgataacaccaccctgattcctgatattggtaatctgtgtgttttatttgtttcttaatctgtgtttctcttctttcttctgtccatttaataccatataaagtagacaatgacaatcatttttatattaaccattctttgtttggggcattgcctatcccatgaagtagagtttgcctcccactctagatctcaaagatggttagtattcactctcccagcttctcttgtagctacagcatgggcacctaactcaggctccaccaatcatatgaacctactatccactgagtctgaggcccgaggtgggaagaagcagggtccccacagatttcactcaggctgggctgctggtggcaggcgtcgtgccacccattccctgagaagcactggtagccgtggttctcttggcagcatcccgagtcttgcaatgtctgcccagtcattggtgggagccacaggggagcctgaactgctgagcactgcggtgagatttgtaatcttgttcctctctgcaaaggtgagtttcttgcttgtctgcatgtgagtgtgggccacagaggatgctgtgctgggtggctaaaactcagagacccagagagcagattttagggtggccatggcagagggaaagcaggaggggcaatacctgggagtagagaagcaccgtgttgaggagctccatgtttggcctgtacactctgcccaaatctctggttgaccctggagccatgcaagcacagggctgagtccaagaaaagaactgagcagaggtttcagctgatgcccaataccaaagaaacggagtctggagattgcagttggtacccaatacagaggagacttcatgtgagtttagctagtttagttgtctactaagacaacaaaccaccaccaccaccaccaccaccaccacaacaacaataacaaacaatgactcatcttcggagaaatataacagaaaccaagaagccaaatctactagaattcattatggacagtgtctaggatataatgctagattactacaagaaacaagaattgtcctgatactcaaggaaaaaagcatccaagggaaactcaccctgggctgaccatagtcgagaacataaagcatgctcataatgatttttatattgatatatgtgcttcttcattaacaagtaaaacagcagtacttaaaggttctttaccaatgccataaattgatgaaatgttatttccagcaaatgtgtctagctattggcaataactgtaatgtgatatgaaaatatttatttctgttggtgacaaagtcacatgtattgccgatactgttgtggtttgttgcctacattcataattgaaggaaacactaaagtttagttattttagtaaaaataaggatgcatttttccccatctgattcgtagatcctttgagatcttaacaccaggttaaggtcttaagaccatagatattgatttctccctgatagtaccaaaaaacatgcctggcacatagtagatgcttcataaatatttctcaaataaatgaatgcatctgtgttacaatctagtgattgaggggttaaaattaattctctagtttttcatatccattaaaacaataaattgataacaaaggctattatttgatgattgtttgctatgtgccagacattgttttataaatattatctcatctaattcttacaatagtcctgaggcaggtcctattattacttctgtttcatggttatggaaattgagccaaacagtgtttaagtagtttgttcaatgccacatggctggcctgagtccacagcctccgtccttaaagtataaagtataaaggtaaaacttgctctgaatgtctcaggcttggcttctggccctcagttccaacaaattcttttccggtctccttcactgactaaggctcagaacaactctatttcacccacatcctcttaggctacctgtggtgccatctggggatatcagcccctcacccagtgatatggtttggctgtgtcaccacccaaattttatcttgaattgtagctccataattctcacgtgttgtaggagggacctggagggagataattaaatcatggaggcagttttccccatactgttctcatggtagtgaataagtcccatgagatctgatgtttttataaaggacttccccttttgcttgattctcattttctttcttacctgctgccatgtaagatgtgcctttcaccccctgccatgattgtgaggcctcccggtcacgtggaactgtgagtccatcaaacctccttttctttataaattacctcgtcttgggtatgtctttatcagcagcatgaaaacagactaatacgcccagcttcacacaaccaccttaaggctaaatgccatcaggtttggctctctgggaccaacttctgctttctaaatctcaatgtccacctgctcactggacacctctccctgatgttcttcaagccatttgatgattgtttgctacgtttttgatatgtacctctatctttcctcctctatcctaatgcaaggtgtaccttccctgtgaggactttcctgaccctttccaggtatgacctgcccacttggtatccccctgtactctgtacataccctatcactacccccagtaaattgtattactaaatttgtttacatgcctgcctcttcttaccattctggcagcttcttaagaacagagactatttctaatttgtctctaaatttctaggacttagaataatgcctgacacagtaggtgcactgtaaatgcttgttgaatgggtggatctatgaataaattaatgaatgaattatatacaccaacctacttatcactttggctgatgtgtttattatgatttacacaaaaccaattgtgtagtgtagaaatgtaaatgttatgtgtaatatgtaaaaggtaaaagtgtaaaaatgtaaaatatatacaaacatggcccaagagaataacaatgaagttttaaataggaaattttagtagagaaaaagaaactattgaaaagaaccaattgggggagtggccaagatggctgactagaagcaggtagtatgggtggctctcacagagaggaacagaaggggtgagtaaatacaccaccttcaactgaaacatccaggtacttgcattgggattaatcaaggaaacaacttgacccacagagaacaaagaaaagcaaaatagaacaatggcccacctgggagcaatacagagccaggggatcctcccctacccaggaaagtggttagtgaatgagcgactctaggaaaccacgcttctcccacagatctttgcaaccctcgggtcagcagatctccttgtgaacccactccaccagggcctttcagttttcagtctgacagacagagccatggctcttggcagagcagctgctcaggcatgtgtggagaacctggaaccttagatacttgggctttccggcaaaagtagttgcagcttcagcaaagtggaaggttagactcctgtacatacccctaggaaagaggctgaatctagggggctgagcagcaacagcctgtagcccccacttccacagcacctcacaagataaaacccactggcttgaaattccaggagttggttttttgaaaaaattaataaaataggccaccagctagatgaattaagaagaagagagaagatccaaataaacacaattagaaatgattaagggaatgttactactgaccccacaaaactaagaacaaccatcagaaactactccaaagacctctatgcacacaaattagaaaacctggaagagatggataaatttctggacccatacatccacccaaaactgagccaggaagaaactgattccctgaacagatcaataacaagctttgaaattgaatcactaataaatagcctgccaaccaaaaaaggcctaggacttgctagattcacagacaaattgtaccagatgtacaaagacaatccgttaccattcctacagaaattattccaaaaaattaaggatgaggggcttctccccaactcattctatgaggccagcataatcttgataccaaaatctggcagagacacaacaaaaaaagaaaacttcaggccggtatccttgatgaacatcaatgcaaaaatcctcaacagaatacttgcaaaccaaatccagcagcacatcaaaaatctaatccaccatgatcaagtaggcttcatccctaggatgcaagtttggctcaacatatgaaaaccaataaacgtgattcatcacataaacagaactaaagacaaaaaccacatggttatctcaataaatgcagaaaagacttttgataaaattcgacatcacttcatgttaaaaactctcaataaactagatattgaaggaacataactcaaaataataagaaccacagccaacattatactgaatgggcaaaagctggaagcattcctcccttgaaaaccagcacaagacaagcatacattttttcaccacttgtattcaacatagtattggaagtcctagccagagcaatcaggcaatagaaagaaataaagggcatccaaataggaagagagaaagtcaccctatctctatctgcggacagcatgattctatatctagaaaaccccatggtcttggccccaaagctccttcagctgataaaaaaattgagcaaagttgcaggatacaaaatcaatgcacaaaaatcagaagcattcctatacaccaacaacaaccaaactgagagccaaatcagaaaggcaatcccattcacagttgccacaaaaatataaaatacctaggaatacagctaaccaggaaggtgaaagagctctacaatgagaattacaaaacactggtcaaataaattagagaagacaaaaacaaatggaaaaacattccatgctcatgtataggaataatcaatatcattaaaatggctatactgcccaaagcaatttacagattcaatgctattcctatcaaactatcaatgacattcgtcacagaactagaaattattttaaaatttatatggaaccaaaatagagtatgaatggctaagacaatcctaagcaaaaagaacaaagctggatggatcacattacctgacttcaaactatactacaaggctacagtgactaaaacagcatggtactggtacaaaaacaggcacatagacaaatggaacagaatagagagcccagaaataagtctgcacacctacgatcatctgatctttgacaaagctgacaaaaacaaacaatggggaaaagactccctattcagtaaatggtgctaagacaactggctagccatatgcagaagattgaagctggaccccttgcttacactgtgtgcaaaaatcaactcaatatgaattaaagacttaaatctaaaaccccatactataaaaaccctggaagacaacttaggcaattaccatcctggacatagagacagacaaagatttcatgacaaagaaaccaaaatgaatctaaacaaaaacaaaaattgacaagtgggatctagttaaacttaagagcttctgtacagcaaaagaaactatcaacagagtaaacagataacctacagaatggaagaaaatatttgcaaactatgcaactgacaaaggtctaatatccagaatctgtagggaaattaaataaacttacaagagaaaaataaccccattaaaaagtgggcaaaagacatgaacagacacttctcaaaagaagacatacatgtggccaaaaagcacatgaaaaaaagcccaatatcactgatcattagagaaatggaaatgaaaaccacaacaaaatgccatctcacatcagtcagaatggctattattaaaaagtcaaaaaatagcagatgctggcgaggttgtggagaaaagggaacacttatacactgttggtgagagtgtaaattagttcaaccattgtggaaaacagtatggagattcctcaaagaggtaaaagcagaactaccattcaacctagcaatctcattactgggtatatacccagaggaatataaagcattcttccctaaagacacatgcacgtgaatgtttgctgcagcactattcacaataacaaagatacagaatcaacctaaatgcctatcaatgacagactggataaataatatatggtacatatacatgacagaatattatgcagccataaaaagaacaagagcatgtcttttgcagtaacatggatgaagctggaggctatcatccttagcaaactgacacaggaacagaaaaccaaatactgcatgttctcgcttataagtgggagctaaatgataagaacttatgaacacaaaggaggaaacaacagatgctggggtctacttgaggatggagggtgtgtgacgggaggggaagagaaaagataactattacctgggtaatgtaataatatgtacaataaacctatatgacatgtgtttatctatgcaacaaaccttcacatgtacccctaagcctaaaataaaaatttaaaaaagagaaacaaaccaactgtaattccggaactgaaaaacataaagtgaaaaattcaatggattgtcttaataacagattgcagatgacagaagagtcatgaacttgaagctagatcaatagaaatgatctattcggataaaccaagaggaacaataatagaaacgaatggaacctcagtggtctgtgggacaatatataaaggtcaaatgtgtattttgagtgccaggatgggatagagaaaatggggaaggaaagctatctgaagaaataatggctgaaaaattcctctagtatcatttttcttaggaaatccattatttacaaatttaatgaaacttggtgaaccacaaagaggataattacaaaggaaagcaacatctaggcacattgtagtcaagctactgaaaacaaagaagggcaagaaaaatcttgaaagtagtcagagtaaaatgactctacatatgggagtgcattaagaacttaattctcatcagaaacaatggaagcctggagacagtggagcaacatttctaaaacagtgaaagaaaaaaaaaaccttccaatacagaactctatatctagggaaatagaacaaattcaagaatgaaggtgaagtaaatatcttttgagatataggaaagctaagaaaattcatcaacagaactgcactaaaagaaatactaaaggaagtctttcaatctgaagaaaaattaaactagaggaaatctttgatctttgggtagaaatgaagaacacaggaaatggtacatgtgtgggtaaatattaatgaatagttatttgcccttaatttctttataataatatgactttaaagtaaacagtttaatagtatatactagggtttggcaactcataaaggatgaggtggaatggaagtgaatctatatgatggagagtttcttacatttatgcacaatattaactttaagtcgacagtgaaaagttaaatatatatatatatattgtaatctctagagtgagcactacaaaaatgcaaagagatatagctaagaagataacggatacattaaaagtgaattacaaaaaatatttgattaatccaggcaggaaatggggaacatgggaacaaaaatcagatggagcaaatagtaaaaggatagacctaaatccaaatatatcaaacataacattcaatgtaaatgggctaaacactccaattaaaaggcagagattgtcagaatgaataaaagagcaagacttttgctgtctccaagaaatgcaattttaatatacagactcagatgggttgatagtaagaggttgtaaattatataccatgcaaggggcaagcataagaaagtgggaaagtctatgttaatagccgacaaagtggagttccaaagagtatcacctgagataaaggtaataattatataaggttcaattaatcagaaacacatagaactcataaacatgtttgcacccaataacagagcctcaaaatatatgaaacaaaaattgacagtataaaggaacaactaggcatttccacaattatagttggagatttcatcatctctgcctcagcaactgatataaccactagacaagaaatcagtaaatatataaaatatatttaatatttaatataaatcagtaaatatacaaaacattccacctaaagaagctagaaaaggaatagcaaagtaaatctcgaataagtagaaggaaggagataatagagatacaagagcagaaatcaataaaatagaaaacaaactaaaagtaagtaaatcacacatattttaaaagagcaaccaaatgtgtagcccttaggaaggctaatcaagaaaaaagaaaataatcattaatatcagccgtgaaagagggatatcattagaggttatataggcattaaaagaatagtgagggaatattaactttatgacaataattttgacaacttagataaaattgacacatgcattggaaacaaagcaatttaccaaaacttccaatggattgaatagaaaaaacacatagccctatacttcataaatatatttattaacaaaaaacttttctaaaaataaaacaaaaatccatgcccagatgatttcatgggtgaactccagcaaatatttaaggaacaaaaattgccaattttacacaacagtttcagaaaatagaggagcaggaaacaattcttaactcagtttatggggccagtacaaacctaaatcctgataaaaagatgatataaaaccagaaaattacagaaaaatatccctcaagaacagtataggaaaactatttattagaaatccatatccagcaatatataaaaaggcaagtgttttattgcccatttccagatgatgggcatacatgttcactgacagatataggccacctagctgttaggtgaggctgcatctgtctgattgaaagcccacacgctttcctaggcaatggctgcccaggtggttgaaggccggcctccagccggtaaagagctggtatgaggaacacagccagcaatcaatctatgttgtagggattccaggcctgagcagggcaggctgtgaataccctggggacctggtcttaggatctcctcctcgtgacttctagtccatcccatcccagcaatttgccacaattactgatggaggtcattttgatggtggagggccaatcggtgggcctgttgctcccagaggctccaagccttggaacattaagcccttaccatgcaggtcccgttgccagggcaacacagatgtctcctcctgtctagccacttgtcttccacagagactacgaaatttttcttcctcatctacctggggcttctgggagaagcgggaagccctgtagtcttagcacagcgggctttggagacccctgcgctgcgcagcgcggccgcgtgactgaggcgagatcttccaccctcctgctccagggcctctaggtggcctccagagtgggctccacagcttgaaggcggcgtttttccgcgggtggtcgcagcgtccgcagagtcggagaaagtgagcaggctccggcgggaccccagagtgaccgcgggcgccctgggcaggtgccagatcgctgcctccgcagtgggcgcgagagggggtcccggtccggcccagggcccgcagagagaggaggagggggctcctggctgcaggagtctggtggggcgggggtggggggtagggtgggctgccgttgcagaggtgcaggggacggtgggagagaggggggctctggctttcgggggaggaaggggacttctggctgcaggtgtggggggcgcggaggggggttgccaggttacacggaagatcaaaagaggaagatcaaaagagggagggggctcctggtttggcgctggaaaagagacgggggaggtctctctgcttcccttctgcagtttgggtaaggaagaactccaggctgcaaagatctgtgtaggggaagactactggccgcagggattctgggtgggggaagagctacctgttgcaggggcttggataggggaggactcctggctgcaatgttacagatgatggtgggagggggaggtgcacttgttgtggtgtgataaggggacatcagctcaggcaaaaggggatctcccaatagaggtggtgggtgtgtgccaagggattaagtgtcaccaactgggggagggctttgggggtgcatgggctgcagcagtgggagggaatggatccctggctgctgcagtgcttgggaggggagggcaaaggcctgtagtgggggtgggttgattggcagcaacgtcgtccctctctcccctttgcactcacaggctgcgtcagagactgcaacagtcagcacacattcctgtctgatcaggctccctccctcaagtcctctgcgatagctctggcgatgcttcaggactggtgcaggaggatgggtgtgaacgcagagcgctctctgctcatcctggatatccctgacgactgcgaggaacatgagttccaggaggccgtgcgggctgccctgtcgcccctgggcaggtaccgagtgctcatcaaggtcttcagaaaggagctcggggccagggcagccttggtggaattcgctgagggtttaaaccaaagcttgattccccgccaaatagcaggcaaagggggaccctggaaagtgatctccctgccccaggcccttgatgctgagtttcaggatatacccagtttccctgcacagccccaggggcaagcagtggccagaggtgcaggtgaagcaggagctgcaggtgaggcaggatctgtaggtgaggcaggaggtgtgaatgaggaaagatctgcaggtgaagatgaggcaggaggtataggtgaggcaggaggtgtaggtgaggcaggagcagcaggtgaggcaggagcagcaggtgaggcaggagcagcaggtgaggcaggaggtgcaggtgaggcaggaggtgcaggtgaggcaggaggtgcaggtgaggaaggaggtacaggtgaggaaggaggtgcaggtgaggcaggaggcgcaggtgaggaaggaggtgaagatgaggcaggagctgcaggtgaggcagtaggtgcaggtgtggtggaggcctggacccagtcatggcgccagaccctgcggcctctggtgaaaactatggcctaccgggaactgagacccttttccgggagggagcagccaggctgcgtggaagagtcctttgagagctggttggaggacgccaaggatatgctgcagctgtggtgccacgcgtcggaaagggagagaaggaggcggctgctggacagcttggatggcctggccctggatatcgtgagcggcctcctggaggaagatccagacttctctgcgcaggactgcctgacggcgctggggcaggtgtttaggagccgggatacatggatgacctcgcggatgaagttcctgacctgcacgcaggggccccaggaggggctgtttgccttcgtggtgcgcctggaaggcctgctgcagaaggccgtggagaagggggcggtccacccagccatggccaaccacctgcgactgcggcaggtgctgtctcgggcccgccccagcgaggcactccaggataccctgaggaggatgcagctggagaggaggccacctgacttcctgaggctgctgcggctcatccgggacatggaggcgtgggcagcctccctagcaaggagccagcagggtgtggcctgggcagcggccccagtggagagtgaagacccagctgctgcccaggcctccccggcccagggggacgccagcgaggctgatcccggagcagaagatgctgatgaggctgcttccaccaccaaagaggccgccagggttgcccctgccactggggaagatgaaaatgcccctgcaggccttgaaggcctaggtcagggaaggtcccccgacgcccctgggggcctcccagccaggatgggcagtgcagtcgacatggccccaggaggtcccagctgggagccagagggccttgtccaggttggaggccaggaggctgaggagcctccccaggaggggctcaagcccatcttagaggagtcagaaaacgaggatgaggatggggctggggaggcgggcaagcccaagtcccccccgggcaaataggctctgagggccctgagggctcctctcctctcaggcagcagcaccctggaggcagacagaggccaggccagggccggtccctcaccccatgttgggagctgtgcctcccacctcccctaatgggtcctggccaccaccaccagcccttcccagtgactcagatgaccacgtttgataccaaatggggagctggcctggagggagctctgagcggccagcctgaagatgtctgccccccaccccttgtcctgtgttgggagagatgggggaaagaggccctctcaagggtgacagctgcctacatgtcccaagaggtggcccccacttgccatccctggggcagactgccccccgttccgggaagcccaccctcacctctgtaggccccatagtgacccacgcgtccgaacagcagacgcccactcacccaccgctagccattgttcctacacaaagttgtatgctgtgcgcccatcggtgcggctgcctctgggcctggggcacatgctgtgagcttcctgctagcccaggctctgctagctgctacctgtcccttgtcgtgagcaccacctctgctttcctggtgtagatctaggccaggggctgcttgttctcgtggagctgtgtgtgttcttctctgagcagctcctccccggaggcccccagcacagtcctgggagatggtggaaggaggcgccagggcacgatggacgctcatcctgtgactgctatggtgagcatgaccacgatggtgcccgtgaccatgatggtgaccatgactgtgtgaggaagaaccggacctgggacagagcagagctgccctgcctgaggctccccggggagctttgtgctttggtgttctattcctgttgttacttgtgactcagtttccttgacttgggggggtgttccctgctgtgttttcagtgtcctgtgagggctatagggcagggccctgccccagcggatgggctcgggagggggctccctgaagccagtggacactgccagagtccaccatcctggcaagaggcggaccctggggccctcaggaaggagggagttggcagcgggggctgcagcaggagtaggagcagatgaggcgtcttgccaggaaccccaggaggagggggcccgggacctgtgtgggacctgtgtcctgtggtggcaatttgcagtttctctctgtgttgtgattcccttctcttcaatggtttcagtacatgtttctcttcaataaacttcattcagtgttccagccggcctcgcctctgctctgggagactggggatgaggtttgctgggcatggggttgggtggggtgagggccacagtggccaggctgacactggggtgtgtgcagggcagggtccctgaaggcctgtggggttctttgggctgcatggagcctggcgacaggatgttggttttcatgggcagtggctgattgaatccccagggcagcaatcctccttgagcactgtggccagaggcgcagttcttgatgggggcctgaggatcctggaacccgccctcctgagccctcctgggactggctctctctcccaacaggccagggagctcgctacaaatggagggtagtcctcgatcagccatttaactaacgcagagtctgtgggcgacagaactgggacaagtgataggcccctccctgcacatgtgtggggaggggacgggatcattgacttggacgtggcgagggtctcccggggctcactcagtctgtgtccacacacttcctccggctgttctggagcacagagcctccggccatccccatggctcagatgatagccaggctcccccaaagcagcctcagagccaatgctgggaatgggtggctgcccacctgggctgaggaatcctggatctaggcgacctgtctgcttgagcggagctgcagtcagcaggtctgcagggcggcaggggccctgggagacactcggcatacacaggccagtgcaggcatgggaggggtagttttgcggggctgtcggggaggggcagggggcggcaggtctctggggctgggcctgcagcctcctcggcctgaaggtgcttaaccggtgtctcagggacccttgtagtgtgtcccatcggggtgccctgcaggcatgcctggggcccccactgtgttctgttctccctgccttcttcaggctgggcacaaccccagcatgtccgtcccttgtgtctcagcagggccaagtcaactgctcactttccaagggcccctccagattttggggacagggcaagaggagagggcatagagcttggctgaccttgccagggcctgtcagggctccttggttttccctgttcagagtggacctgtgtgtgccgtgattcccgagcaggtgtgagtgtgagtgagcgggtgtgtttgagcgtgtgcgtgtgtgtgtcagtgtgagcatgtgcatgagtttctgagaatgtgtgtgaatccaagtgacagcatgtgactgcatcactgagcgtgtgtgagtgggagggtgtgggggaatgaggctgtgccattgaaggtgagcatgcatgtcgctgaatgtgtgtgacactgtgagtgtgtcagtgtgtgtcagtgtgtgtgtgagtttgtgagtcattgtgcgtgcgtgcgctgactgcaaatgtgggtgtgtcaatgagcaggcatgaatgcgtcattcaatgtgtgtttgtcactcaatgtgtgtgcgcatgtgagtgtgtctggaacatgagtgtgtgagtgaatgtgtgtgtgactgtgtcagtgggcatgtgagcacacaggctggacagttgggttgtgaaacccggaagggatctagccagggagtctggaaggaggtaccgggagaaaccagttgcttccccaccagcccagagcaaggagactttgtcgggcctgaaggacgggcccccccggggggccacctgtccccttcatcccagccaggcccttggtgcgtgccagctggcagagctcctaccatgcattgtgttttgctgcacagtcctcaacaagtgcccctgaggagggcggcatgtgtggcctggggacagaaaggtccatcaaggtgccttcctgggtgcccaagggctgaccaagcccatccaataagcagcagcctcctgggctcacagagggcttgagcggtggatgagggagctggatcagagcccaatcatgggggtgaggctgagcagagaggactcagagaagtcccgtcctcaggactgtcccggagtagacaagactgagaggggtcccatcctaaggcctgtcccctcagcagggaggactgagagaggtcccgtcaccaggcctgtgcctgatcaaagtggtctgagagaggtcttgttctcaggtctttccctcgagcagagaggagtgagagaggtcctgtccacaggtatacctctgagaaaatgaactgagacgggtgccatcataagacctgttccttaacgagagaggactgagttgggtctcttgagcagacaggcctctctccaaaccctgagcggtgggaactgggaaaggtgctgtcctcagctctgtccctgatcatagagaaatggcagaggtctcattttcaggcctgttccatgagcaaagaggactgaaagaggtcccatactcaggtgtcccctgtgcagaacaacagaaatgtctgacagagtacaacccgcaggtctctttctgatcagagaggactgagagaggtcccatcttctagtctgtcccctgagcaaacaaaactgagaggtctcatcctcaggcgtcccctgagcaggaagactgagaggagtcctgtcctcagacccatccctgggcagagagtcataagagaggttctgtccacaggcccatcctctgtgtaagaggtcagagagggatcccatcctaaggtctgtccccttagcagagaagactgacagcggtcctgtcctcaggcctgaccctgagtagaaagcagtgggagaggtgtccccgggcagagaagactgagagagatgctgtcttcaggtacctgaggcttagtgggcagagagaggtcctgtgctgtggcctgtcttctgagcacagtcgactgagagaggtcccattcccatatctatcgtagagaaaagaggacttagaggggtcctgtcctcaggcctgtcctttgagcagagaggactgagagaggtcctgtcctcatatctatcccctaagaagatggaccgacgggggtcgcatcttcaggcctgtcccctgagctgagggggctgagagggttcctctcctcacacctatcccctcagatgatggaccgacagaggtcccaaactcaggtctgtgtctagagcagagaggactgagagatgtcctgtcctcatacgtatccacttagaagatggacagagaggggtcccatcctcaggtccgtcccttgagcagagaggactgagagaggtctggacctcacatcaatcctcttagaagataaaacgattcgggtcacattctcagtcctgtcccttgagcagagaggactgagagaggtcctgtcctcacatgtatccccttagaagatggactgacagcagtcccaccctcaggcctgtcccctgagctgaggggatggagagaggtcctgtcctcatatttatcccatcagaagatggaccgacaggggtcccaccctcaggcctgtcccctgggctgaggggaccgagcgaggtcctgtcctcatatctatcctcttagaagatgggccgaggtgggtcccaccctcaggcctgtcccctgagttgatgggactgagagaggtcctgttctcttatctatccccttagaagatggcccaacaggggtcccatcctcaggcctgtcccctgagctgagaggaccaacagagttcctgttctcctgtttgctgagtgacatgtatgtggagaggtgtccctttatgaattgctcctgagtagagagtactgagtgaggtcatgtcctaagatctgtcccctgagcagagaggactgagaaaactcctgctccctcattggctttgatcagagaagactgggagagtcgtggccttagctctttcccttagcagtggggactgagttaggtcctgtcttcaggtctgtttcctcagcacagtggattgagagaagtgccatcctcgggcctttcacctgagcagaatgaactaacaggggtcccatcctcgggtctgcccctgagcagagaggactgacaggggtgccgtcctcaggcctgtgccctgtccttctatggatagcaccccggggtctgtggcgggccagcatattttgtacttaattttaggctcatctgagaacctgtcgattcactaccttgtaaggtaagtctatgtcccattgcagttggttgggaatgacaagtccaacctaggggcatggccgggaccccctgctgcttctcccacaggatccagcaccctctgtggcctttctggactcccgacgtccacctgttcctggcctgggatcacctcctcttggtgagctgtgtggcagcttcatttttctgaagatgaagacgccacagagcagtcactttcccagccactcccatggcagggtgccaggaggaaggtcacgccctgggcagtctggctctagatgggctctgggaatgggccctctggctgccagacacaggaacagggcctggcacagaagagtgaggcccctgggggccatccttttcccagcccttggtcctctcccctggagcaagataatttggaaagagctgaatgtgaccttttccctctgtctcacctttctctttgcctgtgcaaacagggccacctcccaggccctgactccttcacccacagtgggttgtgcaaaggccaaagcagaggcacctgctggctgcttccctgggcctgcagggcagaccctggtcccctgctgctgtggttccctgagccatgggccccagaggctcggctggctctgggcctgggcttacactgtgctgtctgagcttttccccacccacagaccctagcatttgtggggcagcctctctcaaggctgccatcttcctccagatcctaccccttcctcagggagcccagagcagggcctgcctcccaggcctgcagtccctgcacgcagcagtcagtcccctgagcgttttggcctccagcacctccagctgccctgctcctggctccacgtgcctgcttgggctcaaactcatggctcccattctcctcctggaaagccccaggtccatctatccccagaacctcattgtgagccacagcacctatcacaaagaaagacaagcagcccccaagcagatcagtttcctatcctgggaataggggtgggtggatttctctccagcaaggctgacagtcagcccaatcaccagtgagtaccctggggacctgtgaccctattccagggcacatcgcactgctggagactgggccctgaagccctgtctccctgagccccagatccaggagtcctagcgcacacccacctgggttctgcatagtgtggccacactgcatgcccaccacactgcactttctatagcactgcctgtggtcttgccttctgtggcacccccgtatcttgctttcagtcccccatggccatttgacagccatgattccacctggccaaatcagggacagcagaaacctggtcataatggccctccccccacaccagccatccaacacgaggtgctgaagggtttggagcctgggagaatagtgagcctctcccttagagaactacctagggccaggcaccaggctgagcaattgagcctgcgttgactcctcaagctgtcagaggagccctcgggaggggaggtaggcagtgtcacgaccactcttctccaaatgaggacactgagcacaggaagtttcaggaagttgcctacagcgacacagctcatcagtggatgtgttgggattctaacccaggctgacagacctcacagcttgtgccgtggaaacagccggaggacaggtggcatgtggttaatggtgacagcccttgaaaacatggccagaggacacagggcctgcagttagcagtgatcagcgctctcttggtggtcaacacatgttgcttctgtaatcagaaaaacaaaaatcccaaaccaatgtcaatgtctttttaaagactctaagaaagagaccagaataacatgggccacacgttctcagcgactgcctccatccacttggggacctgagatggtcgtgagcactcaacttctttctactcagtgtctgcaatgtccccaggacctgtaggagcctgtgctccttagggcggggctcccagagctgaggctcagtcttctgctctggtctgttcccaggcagggacttgtcagggcatctcttcagtgtcccctgggctggcaattgctatcctagtcctttgggccatagacagtgacagctggaacaaaagtgacactcgctgagctcttgatacttgctaggcgcctccttaggagtttgtgtgcattgctgctggctttacctgcagagtctggagatcctttgctggtacaggcacatggtacttgggctgcgtgtgtttggtttggggtggggacgtgtgcattgaatgagactgggagccacttgggagcacagaactcagtctgggggactccacggcagtcctcggaggagatgcattctgatcttggtcttaaaggccaagccactgttaaagggtggaggactggggaaggaggtgtcgccaatgccagcagcaggatgcatgtggaggaggctgggactgaatgccaggaacagggcagcagtgagagggcagtagtgaggcgtgaggctggagaagcaagcgggggcccatggtgaagggtttttcctaacaggtagggagctgtcttggaacatgccatggaaagaagcacattctgtggaaaaatactcaagtgtggtctgtatcgggagagaggtggccagctctcgccgttgctaagggaaccactgtgatgacaagtcaattgtggcttaaaagcaatttggaagggtcgagaggttttgagaatagaccagaaaataatcctctggtgaatgaaaactagtctccaaagatagcctccccagagacacagggctaccacgacctccttgtgtcacacccatgaatctgtgaggtcacatggcaaaagggactttgcagatgcaattaggttactaatcggtggtccttaaaatagggagattatcttgcgttctctgctatgcctggtttaggatgcacatgagcctttagaagaagatctttctccttgcggagggcagaaggggaaatcagagagattcaaagcatcagaagaactcaacacatgatttctagttttgagagtgtgggggaggcacatgcatggactggagagaggcctctaggagctgagaacaatccaggaggcagctggcaacaaaatggggaccacggccctaccacctcaaggaactgaattctgccagcaactttagtgagcctggaatcagattctcccccaaagcctccagataacacccagctagccaacactctaattgcagcctaacttaacccagttaagttaggcctggacccctgacgcagggcaattgtgcaataataactgcatgttggtttaagcttcaaaatttgtagtaatttgttatgtgaagctggattaggtagatagcattgcactccccctttaagtgcagctctttttgatggccatggcctttctcatcaaggccatgaggaatggtgggtgctgggcttcctttggtcaacttccacctaggttcctggctcaagtcattaccatggttgcaacagtgcaaaatctggcagtgttttcttcctcactttgtctttttttacaagatttcattccctaaatttactaaccaaactcatttgattcctagcaacacttctcatcactgcaagccatagctttaaatggcggtgaggtctgcagttgtagaagatgttaaagttctggagaactccacttttcttcttttttctccttccctgtacattccatcctcctctggactttcggtgcaagagtcttggaattgattctaaaacttgtaggtccagatcattctccccacctgcactgtctgagcacggctgtcttaaagaaaataacccccacccccttagcccaacacaatgttcccagcttccgtgaggcccagcaaggaccttcacagcataaaacccagttccctgagtaacattctcatgtgtatggtgacaaaacacaacacaacaaggtcttgtaaggttttgccctggaaaccttctctagttccttattaccatggaccaaaatatgctatttgcttccttgatttcagccccataattttatcccataccattttcctttataatttctcaaatttgtggcattggccactcttatgggttgaattgtttcccctcctgctcccccgcaaaaaaaggtatgttgaagccctaatctcccagcacctcagaaggtgagataggctctttacaggagtaattaagttaaaatgagggcgttagaatcggccctaatctgatatgactggtgtccttctaagaagaggacatttggaaagacatgcatacatacacacaatgccagggtgaagcttggagttctgctgccacaaaccaaggcagtacttggaagctaggagaggggcctggaacagatcattccacagagccttcagagggagcgtggccctgcccatattctgatttctgacttgcagtctctggaatggtgaggcatccatttctgtaggttcagcctcccagcctgtggggtcttggtcacggcagctggaacacacttacacaatccagttgttgatctcaggcagtttgcaagctgaacccacaattccctatttgtgctgcatcgatttgaccctcttgtataaaaacaaagaagaaagatcttaaaaatcagggcataaaaattgttaatgtagatatatgatgtttcacatggattacaaaaatcttccacacttgctctcctaagtttgcattctgtggtacctacaccatcatcacagaagaaacaaaataaagttgtctttaaagataaagaccacactgtccccaacctaatatgccatgaaaggtttttttgtttgtttgtttgttttttaactgcattccattttggagcatcaaatgaagcaagattaactgactagttctttaatacgagcagctttcaaacctttgggtctcagcacccctttgcactcttacagtttatttaagaccccaaagaatgtttgtttatgtggagattctatctctatctctatctatacacacagtatacattttgctgtgttaaaattaaaaaataaaaataaaaatttcacttactgaaagatgtcagtaataaaagcattgcacattaacaccaataacatattagacagctgaactttcatctgcttctgacttccacgcaccttggcatcacactcaggtaacctctggaaaactccatggtatccttgggcaagaagaaaagagccaaggcaaaaatctcttcgtgtcattataaaaagagatttgatcttgtaaagcgctgcctgaaacggtctggggaccctttggggtccctggacccagatgtgagaactgcagtgttagcccatacttcttgggtccttaggacatgtatcttgccctgaccctggtcgctgttagcgttaaccgtgcctttcatgtctgcgggtgctccttgctgcacctgtcctgtgtgatgctgttactgcatgcaaagcaatcaggagtagcatggatgagtcaacagaatgcccagaaataacgatggaacagtggttaggccagggctgtggagggccctgcaagttaggcaatacagagcagtctttagcaagcatttctgtaagcctgtgcttgctgggcataaaaggataagtaggacaaggtcactttccctggaaaagtaagaacccagcatgggatacagataaagacaaaacaaagtatgcacagtaaactgagatcattgctactggagtagcaaatagaatgctggggtggattgttgcagtgggaggaggacgagtcacagagaaagccatgttctgtgagcatatctggagaatttcccaagggagttcggggagggggacattccagacagggcaaagggtttgtcccaaagatgcaggcaggacagaatctccaggatttggagaactgctgggccagtgctggggggaatgatgggagatgaggtggagaccggggccacagaggtttgtgtggttggctgaattctaggcccagttccaccacttagtacccttgtgactctgagcaatgctcttaaccttttggaacctcagtttcatcatctgtaaaacgaccataataaagatattcactgggagtgcagggaacatcaatggggtagtgtgtaggcagcactcagtcccacatagcccccagggcccacctgcggctgcctccatgagcactgtcagacccgggagtcctctgcagcctgcccttcatcgccatctagcaccactccctccccacctcccggcctcagtttcctcatctgcagaatggggatcataatatgtgctctctgggtggagcgagcaattgagattacaagagacagtctctcctgcacctcagtggccactcctgtctgtcctttccatcactgctgggattgctcttccaggtgtccccagcatcactctgtgcatctccacactccgcgctgcgcaaaggtggggtgggaagcagcagtgccgttttcccggaggggcctccccctacagtcagcccggctcctgcctgcctgggccctgcctcggggcgggaaggctgggctgcacttcatgggatcccaccagctcctatgagggggcagggtggttggggcatggcaggcagggatccgagggtgcgggagcctgtggtcacatgggcaaaggccagaaggcggggctctggagccactgagcagcacagttacaggtgttccacaggcacagtgagcaccttgcaccctgcaccctgcaggcacctaggctctgctcagatgcaccgcaggcctggacttccacgcagcagcccctccccagcatccgggtcctcagggagcctagggaaatgcaaatgctagggcttcggtcctgttctcggaatcagtcttagggtggggccttggagtccgcattttagtcacatggccaggatgatgctgagaaacatgtctgaaactggggtggcaatgctgccattccaggatcagggacaggggaccacgcaagattaaggctgttgaaagatccaggcagcttcggaattgaccaggactccaaggttttgagtataactttgagcataatttcagttttccattgtattccaatccttcggagtgaaaaatctgtaagtgttgtgcttagtggcccaataactagatgccattctcaataactagctgctcaggacacctggtgtgaatgtgtggggtttagcgcctaggctgaatgtcccaggctgtgaatgagtaggtggatgaggaggaactcagatgaaagggtcattggatggtgaactcattgctactgactatgtgggggaagaggggagaagttagtcaataaggtggcttgggggcaagggcgggccctggtgacatgggccaggaggagactgaattccatgactacactcacagtaattacaataactgaagcagatgctgagtgatcatgacgcatgtattaaacattctgtgttggttatttcatagacacctcatgggaatccagtgtgaccattttttttcaggtgaagaaacagagatggacaggctaggtgacttgccaaggccacatagctgctctctggtagggccaggaattcaaatccactttctcctcacacgtggtggatcaccatcactttcctttgctgacctgacttgttgagatcatttgcagtggagtcatttgagaatatatgtgatttaataagtccaactccacgagtatctggttactgaggggcttattctggttcttggtgctgtgggagatataaaacaaagagatgatgcagcctgctcactttcaattaccagcaaggatttcttattgagcactcccgtgtgccgggcactgcagtgagtatggcccacacagtcctttgcctcatgcagcctgcaggctaatggcagtgagacacattactccaataaccacggcatgtgattgacagctgagactgtgaaatcgagagcttctcagacaatgggggtgcatgaatctgcctggggagccttccagacctcccacacctggcctagtgtgggcagtctggaaggctcctccgggcagattttgtacacacatgtatggtgcatgcatgtaaagctagaaccaacttctttttatccattcactgagcaccctcaggtcctaaagtctccacttctggaaaaacacgatggcttctcccaaagagcccaccagctagtgggaaggcagatgtgaaaacctggagagggctgttcagttggtctgtgggagccaagagaaacaaatgattaacttgacattcaaggatgacttcacaaggctacgacaagagagaaatgtcaaggatgtcccggttgaccacgtctgcttgttcctgccatcctctctttttttggctcactgctgaaggtgtacccatgacctcttgttctgtgcccccctggcatcctgtcctttgcagagcactgcctataccagcagatggtaaactctttaggatggcacttggcacactgcctgtcacatagtaagtgctcagtagagctttgtgaaatgaatggataggatgaggggtagctcattttcagaggttcacaggagtgacagagcatagaagcttctggggatagctttggaggagtgctgtgccaaatcacaaagaactatggagactacgttaaagattttggacttgtgtcccgtaggcactgcagatgtttggaaggctttgaagcagttgtatgtcagcaaggtttgcttttctgaaagctcagtgtggtggtcgggtggaagataggattggtacaggagagggtggattctggggagttccttggggtgattgcaagaatctacaatgacttgtctgtgtttcagggtagtgggcctggagacaaatgattgtgttctagtcctatttaggaggtgggattgccaggacttgttcaggattgggtaggggacatgagggagaggaagcagtcaagggtaataatggctataatctgtggactaccgatggggtaccaggcacctacctcaattatttataccccttataaaccacccttcaggttctgagttattatccctgttttaaggatgaggaaactgaggctaaagagtaagcaaaagagtgagatttcagcagtgctagccagaggagctttggaggcgaggttatcactccctgctgtcgagaattcaggcaagctggagagcttacggggaactaatgaggtcagttttaagcatgttcagtgatcaggagataacccaaaggaaatgccttctagacagctggaaatgtaggatgagaggtgaggagagagtttgagactacggggaagatttgagaatcacgggcaaatgggcgatggttgaaacctcagtgcaaaagcagttccgggaagtggtgggggtgagtgctggtcccaggagagagacagaaatgggcagtgaggaaacagcacgggccaggaccagtgcagactcttttgttagaagtttggctctgaaggggaagggaggcggggcagttgctagatggacgcaggatgaagggaaggagcatttcatggtgtttgttcattcatttgtttttaaagcatagaaagccttgagtgggttaatgggctgaggaaaggaggaaagccgctggccaggaggccataggtttttctccagtggacatttgaattgatgaatgtcctctgtacatgcttgaattgggtgaccatgtcagaagggctctggaggaggtagcagtcacctgcattcatgcgttggttccccagtcctcacgtgcatgtttctcaggagagtgaaggacttcctctttatggacaattaggtagctggatggtaactcaacagcttccaaagagggcaggaggctgtcatccctggagacagagggctttaaaagcagcatggaggctggtatccgggaacttcttgccttctgttcacatatgaaaaatgcatggcttttcatcactactgtccttctggcagggcactctgagtagcaacacaggggttagcacacagtctcagtgccatgggccatcctggtccccattatgcttcacatctgtgccccaaaaaggactgggctctgtctccatggctgatgctggcggaggctgtggggatatggtagtgaacaaaacaggtttgcctcttggagctgacattctagtggagggaagcagacaacaaaagagttaacagggaaatttacactaaacatgtcaggtggagagatgtgctgtgaactgattgtatagcagagtaaggggctggggaacatggggagggggttgcaattttactttgtaaaaggtggtcagggaaggtccctgagaacgaggtatttgatcggacagctgcaggaggtgtggacagctgtggagataatgagagaggcatggtctagcacagagggactgtaaatgcaaaggccctggggcaggagctaactacagcaagagccagctgaagcccccacaaatgtatgtgatcctcttgtctcttggcttcagtctggctctgtggttcttaaacttgcccccaatttgtgaatccgtggggcagagctttggagcacatgaacctggattcgaatcccaactttgctcctttgtacttactttgccaactgggcacctactggggagaatcacaggctctttgagtgcctttcagttggaggggaatcttgggcatctccccagtgcccctcattctacttgcaaggaaaccgatacccaaagagagtggttccttacctaaggtcacacatggtggccaaataaccccttttctcagttttgttagaaaacaagatatcttaactggctctttcatcatctccctgatttttatttgtagtcaacaccaaaaactctacagcttatttaggtctgtaaaagcctgttcaccattctccaaagaatacagaaaagaaccacaaaagattccctgctccctgcttcccgcactggctccatgggttagacacaccttgggccaaccagcgagtagccatcttcagagtggatagatggatgggttaagataatgaggcagcacacacagttctttcgaacatttgaaatcacctcactaccttgtaagacacgaaaaactcagccatccacaccaggggtcagcatgtttttcctgaaagagaagatagcatcgattttctgtcacaactacttaactctgcccttgtggcacaaaagcagccatcaaaaatacaccagatttccagaagggtctgcaatcataaaaagctaggaatcaccaatttttgccctaaaactgagggcatatttcctcatgccacttgggagggcctaccctgggagatctactggaatatcatggaaagtttccacttggactccttaaccacaagggtaggacagatgccaagtctttccttacatcaaatctaatctcgtacatctctcattgaatcctagaattaaaaccaagtagcttcaaaagcatcatgaagatagatcttattctaactctttcacaaactcagcctggagagtctgagcctccgacctgccttcctgcctttcttgtctgcgctggacatgcctcagccacttctggacaatgtgtttccaccaatttgaaacttttcatgagtctccatccactatttatttttaattaaaaatttttaaatagacacataatacttgtacatatttatggggcacatagtgagtttcaatacttacaatgtacggtgatctaatcagggtaattcacatattattcatctcaacatttatcatttttttgtgttgggaacattccaactcctctcttctacataataaattattgttgactgtagtcaccctacagtgctatagaacactagaactcattcctcccatctagctgtcatttggtatcctttaaccaatcctttcctactctctctcccctccacctttcccagcctctagtaaccactattctactctctacttctttgagatcaacttgtttagcttccatatatgaatgagaatatgcattatttaattttctgttcctggcttatttcacttaatgtaatgtcccccaggctcatcatgttgccatgaatgacagaattccttcttttttatggttgagtaatattccattgtgtatagatatcatattttctttatcaatttatctgttattggacatctaggttgattccatatcttggatattgtgaatagtgctgcactaaacatggagatgcagatatctctttgatatattgagttcctttctttggggtatatacccagtaatgggattgctggattatgtggtagttttatttgtagttttttatatacccagtaatgggattgacagatcatgtggtagttttatttgtagtttttttgagacacctccatactgttctccatagtggctgcactagtttgcattcctaccaatagtgtataaaagttctggtttctctgcatctttatcagcatttgttattttttgtctttttgacaatatagccattctaactggggtgagacgatatctcattgtggttttgatttgcatgcccctgatgaatagtgatgttgagcattttttatacatttgttgattatttctgtttttttttgagaaatgtctgttaagattttttactcatttttaaatcagattatttgtatttttgctgttgagttccttgtatattctggatatcagtcccctgtcagatgaacagaatgcacatattttcttccattctgtaggttgtcttttcactctgttgattgtttccttttctgtgttgaagctttttattttgatataatcttatttgtctacttttgcttttgttttctatgcttttgaggtcttatttataaattcttttcccagaccaatgtcctaaagtgtttcccctatattttcttctagtagtgttttatagttttgggtcttaggtttaagtctttaatccattttgaattggtttttgtataaggtgagagataaggatctggtttctttcttttgcatatggagatccagtttttctggcaccctttattggagagactgtcctttccccagtgaatgttcttggtgcttttaaaaaaatctgtcggctgtaaatatgtggctctatttctgggtgttctattctgttccattggtctatttatctgtttttatgccagtaccatgctattttggttcctacagtgccttatttcctttgtgttgctatgaaggaatacctgaggttgggtaacttatacagaaaaggggtttatttggcttacggttctgtgggctgtataagaagcatggcactggcattaacgtcaagtgagggcctcgagctgtttccaatcatggcagaaggggaaggggagctggcatgtacagagatcacatggtgagaggaggcaagcaagacagagagaaggaggtgccaggctctttttaacaagcagttctcatgggaaataatagagcatgaactcactcactactgtgaagacgagggtggcagccagtcattcataagggatctgcccctatgaccaaaacacctcccactagttcccacctactaacaccgccacactggggattaaattttaaaatgtgatttggagaggtaaacaaaccatatccagacaatagcatatagctatgtagtatattttgtaatctggtagtgtagtgcctccagcttttttcttttttcttgggattgctttggctattaggggtcttttctggatccatacgaatcttaggattgccttttctgcttctgtgaagaatgtcattagtattttcatagagattacatggaatctgtagatcactttgggtagtatggtcattttaacaatattaattcttatggtccatgaacatgggatgctgatatggtttggctgtatccccacccaaatctcatcttgaattgtagctcccttaattcccatgtgttgtgggagggacccagtgggagataattgagtcataggggcagtttcacccattctgttctcctggtagtgaataagtctcatgagatccgacggttttataagcagaaaccccttttacttggttctctcattctctcttgcctgctgccaagtaagacatgcctttcacctttcatcatcatcgtgaggcctccccagccacgtggaactctgagtccattaaagctctttttctttataaattacccagtctcaggtgtgtctttatcagcagcgtgaaaatgggctaatactggtgccttttatctttgctgtcctcctcaatttctttcaccaatattttatagtttttcttgtagaaatctttcacctctttggttaagtttattcctaggcatttgattgtttttgtagctattgtcaatgagattgcttttttgatttatttttcagctagtttgttgttggtgtatagaaatgctactaactgttgtatgttgattttgtatcccgcaattttactgaattcattttttagctctaagagtatttttgtgaaatctttatatatatatatatgcatgtatgtatataagagcatgttatcagcaaagagggacaatttgactttcctctttccaatttggatgctgtgtatttatttctcttgcctaattgttctggctagtaattacagtactatgttgaacaagagtgttgagagtaggcatccttgtcttgttccaattcctagaggaaaagctttttaagtttccccattcaatacgatgttttgggttggtttgttatacgtggcctttattgcattgaggtatgttccttctatatctaatttgttgagagtttttgtcatgcagggctgttgaattttatctaatgctttttctgtgtatattgagatgatcatttagtttttgtcctttattctgttgatgtgttgtatcacatttactgatttgttatgttggaacatccttgtatctctgggctaaatctcacttcatcatggtgaataatctttttgatgtgctgttggatttggtttgcctgcatttttttggaggatttttgcacctctgttcatcagagatattggcctgcagtttccttttgtgttgtgtctttatctggttttggtattagagtgatgctggaatgaggctccactgtctaagaacaatagggtgttgtagattttatcattgttcttgcctcaagatgtggcagtgcctcctcctgaagcaggagagagaagggagactctggcttcttttatgggcaacaatggcaggtccctttcctgggtgctgggagggagttgtggtaaataggcatacaaagggtttattctccagccccccttaacataccataagacactaccaaggagggtggtctagtagcattggtctccaggtgtgctcctggcttcctgatgtgaacagatgccatttaggcccacagaaatttcctttaattttttactggatcccatgactgctgacttgcccattaccttatgctatgtgtttctttagttcctatctctttaacccagagaacttttctgtgctgtgttttttttttttttttatcatagtaccattttaactgtaaaatatcaaaagcaaaccaacatccaacaatggctaaactatccattcaatgaaatgtcatgcaaccattaacatgacatttaaaactattttttagcttggaatattgttcaaaatatgttaaatagaaaaaaggcaggatataagattggatgtactgtgattttctttctgtaggtcttgcaggaagcaggagtcacacttgagctgggtaattgaggggaatgtgggctggaggtcgggaaacctcaagggatagagccatatcctggggctggagacagtgaggatgataggatgtggttggcagtgcaaaggaaaatgttacagatgactccactgtttctagcttggcacttgggttggaaggtgccaccaacagagacagggactatgggagaaaccacatggtggagggatgagttggttttcatcatgttggtgttgaattgtcctggggctattcagggggtctttggaaccatggaactggagccctcttccatgatcttctgagtatcagtttcttggctattctattttctcttttcccatgttgccacatgccgtctgtacctgtcgtgattcacgaaagagggccatctctctcaagatagaactacagtgtgtctcttcattctcaggaacaggatcaacagcttccaactgtaagtgatgttaggcctggtgcaagagaaatccagtggattcttgagttttggagatatgtatagacatgcctggccagggtaggaagaagggacaagcagggatgtggaagtgagaacagcttagcttgggtagggagccccatcaatcatctcctttgtcttgtacccctttctcttccctggaggtgaggataggggtgatttgggatgaagcagggcctgccgcctttcccatttcctctctccttgtgttgtttcttctgtcacctattgttgagtaggatggcttcagcattctatccctgcaatgtgactcacactttaaaaatggtctcaaggatgtctctataacctttagggttgttgggacagtggaagtctcagcaggctggagtgttccctctggatcttacccttcttgtttatgtggtttctccaaagttgagtggatttgcatctggttagagtggtgtggctgagagagagagagagagagagagaagggagagagaaaggaagagagacagtgagtaaacaatgctgagggcagagctaggcttggtagagaggctcatctctggtacttcctagccatatgatctttgggtacattttttcacccctctaagcctcagttttccccctttattgtttgctggttatgtaagccacttgtgcttatcatggaaaaccaaatgttatttattgtcttgaaacctaactctaatgtcattagtgtattctttcctttcagtcatttttttttttttttttttaagcaggggcgagcgtgtatctttaaacatacttaggaccatactgtgtattcagttttgcttttttccactgaatcattttttcatgacaattaaaattccttaaaaattctttttcatatctaaataataattcttcacattgtagtgtagttctctgacgtacataaccaatcagttctttgttcatcattttggcttttcgtctgttttgactgttttcaatgatgctgcagtgaccatttttacatttaaacccttattttcagtctctggtttgttttaggatagatactaaatgttcctttactggctcaaggcgttaatgcattttgagggtctcattcaatatggtcagattgctttctacaaaacctttaccaaattacactcgatgggcagtgtctgagtgagagttccttctgaatgtgccttgtccagcgttccttattgcctttgtacaaccttcactaatttgataggtgaaaagtgacatatcattttaatttgaatttgtgtttgatgactggtgagtctggatgttgtttgaagcattaattggtagattactcttctatgaattgtgctttcatattttttcttgcctattttccttgtcaggtctcagtgggtaggctgagacctatatgtaggactcatgtgagtcctatacataggaccagcagtaggacacttaggttgatctcatatcttggctattgtgaatagtgctgcaataaatatggaagtgtagatatttctttgatctactgatttccttattttggatatatacccagtagtgggattgctatgctggatcatatggtagttctacttgtagtttttttttttcttctttttaagagagccccatactgctttccataaaggctacactaatttacattcccaccaacaggagaaacatgggtttttggtgcaccgggaatggttctgagccctaactgcacaggaacatgtgggtggggctctaaacttatgtcagtgcctggaccccatcccagaatgtatgtacttctttctgtttttctttttttttttttttagatggagttttgctcttgttgtccacgctggagtgcaatggtgcgatctcagctcaccacaacctctgcctcctgggttcaagtgattctcctgcctcaacctcccgagtagctgggattacaggcatgtgccaccacgtctggctaattttgtatttttagtagagacagggtttctccatgttggtcaggctggtctcgaacccccaaccttaagtgatccgcctgcctcggcctcccaaagtgctgggattacaggcgtgagccactgtgcctggccgagatttcatctcttcagaaacagagttgaactgggaccccatttggagaaagcttggggcagtgagaagcaaagtgcaatctggtagaatctctcagtagctggttccctgggccacttaacctttctacgtctctctctctctctctctcgatttgtaaaacaggagcaatgatacttaccttgtaggtaagtgacatgcaggcaggtacttaaagtaaagcagtatatgaaaacttctaagatatgaggaagcaggaaatgacactcacggctaacacattcactagagttttgtctctctctgtgtgtgtgtgattatttcttcttggaatatgtcttcaactgtcaaaatctccttacaattccagattaaacacctttggtctctgatagtcacagccaggttcctacctgggaataactaaaaaatgttccacatgtaacaaactgcagcttgaagtttccgttacattgagcagtcctgtgcatctaggtcttctgttcaagcgtgaagtttgatgaagctgctcgagctcatgaaatctgtagttgtcacaaggcttagaggggcagttaatacctagatttactttgtgggacaagtgcagtgatgtatttatagtctagaatgacaattgtacaaatacagaatgggcagcactttacctactgataaatttgcattaaatttacaaacatgcaggcactggggctgtaaaacgacacgaggttgttcattgacagatgaatggataaacgaattgtggtacatccacacaatggaatagtattcagctttggaaaggaaggagattatgacacatgctataacatggatgaactttgaagacgttatgctgagcaaaacatgccagtcacagaggggaacatactctatgattccacttatacgagggtctagagcagtcaaattcatggagacaaaaagtagaatggtgggtgccagggtctccggggagggacagaaagggagctagtgtttaatggggggacatcatttcagtttggaaggatgaaggtctctggtgatggatggtggtgatggtggcacaacaatgtgaatggacttagtgccactgaagtctacacttagacatggtgaaaacggtaaatcttgtgttatgtgtagttcactacaattaaaaaaaaaaagacaaggaagtcagtcacaaaggttcacatatgacaggaagccatttctatgaaacgcccagagaggtaaatccatagagacagaaagtgcatttgtggtttccaggggctgggaggaggagtaaatggggcgtgactgctaatgggaggaggagtctttgtgaggatgatgaaattctttttggaactgggtagagatggtggttgcacaacattgcaaatgtacttaatgacactgagctgtacactttagagtggttaaaatagtaaatgtaatgtgatgtctatttcaccacagtgaaagcaacccccacccccgcagtgtgctgcagatgtgcacctgcaggcaggtggtgttttcgttccccgttgctgccgtaacaaattatcacaaacccgctgcttcaagcaacacagatctatcgtcttacagttctggaggtcagaagtctaaaataggaagttctaggggaagaacccttttccttgcctttcctgtcaccttgaggctgcctgaattccttggctcttgactccttccgtcttcaaagccagcaacatccggttgagtccttctctggcggcatcattctgacactgactcttcttcctccctctccctcacttaaggacccttgtccttcaagtgtaaagacctggccaatccaggataatctccccacccatctcacatctgcccaatcgctattgtcatgtaaggtaacatatgtgcagctcccaggggttaggccacgaacatctttgggggctgttactgtgccaccacaggcagtaacgagctgagtcttgtgcaccctgctcaagggctgggtcctgcagatgaggtgaggagatacttctggcatccttatggctccctgtttgattctgggggggcccctaggcaaaggccaggctctgctaatctgggccaggagctctcctctctgctctccctgacttctgtgctcactggccctgcagtggcaaggaaaaggattcgtcccttagaacttcccgttttggacttctgacctccagaactgtaaggcagggcagggatatcagagagttcagacccaggaggtgcccacaagggcactgagcatgcgaagacttccaggcagtcagctcttcatccccatcacattctttctagccgagggaaatcctccagatgcagcgagtgtggcaaagcctgccgccgcctctcgggctggactccaaggcagagggcaacccctgagaagcacggccatgcacaagctgagacagggccagggtcatggctgaattgtgccccccccacctgcacctccccccccccaagaaaaaaaacacacatggcctcatcctcaccttctgatcttgcaaatgtgaccttatttggaaaaggggtcgttgcagagatcatgaagttgagcattttgagaggagatgatcctacattacccgagtgggccttaaatccaatcacaaatgtccttataggaaccaaacagaggagaaacgcagacatggagacccaggggagaaagccacatgaagaaggaggtggagattagggccaggaggccacaggccaagggacacctggggccactggaagctgggagagacgaggaaggatcatcccctggagccttcccagggagcacggccctgcagacagcttggttttagacttctggcctccagaactgggacagaatcagtttctgtggagtgattgggtcaactggtttgtggtgctttcttacggcagccgagggaagcacacagaggcagatgtatttagaggggtaccccctgctgcaagcctcctggggcaggggccatgccactctccttcttgaactctgctggccacattgtgctcgctcaggaaacgggtgctgagtctactgctgcttgaggcagagcttacggatttgtaactgcttctgtgtggtggcagctcctccttgcccagctcctccttgcccagctcatcctatatcaatgatgctgccgccacaaaacatccccccaacccagccaaactcctcctgtctgcctgcacctcttatctctgctcaccacggggcccctccaaggggccgtctttgcttccatctcccgctgtgggctggcagacactggcactcctaaggctcttttggcatccctagaggacccaacagacacctccccaccaaagaagtgcacacctagatatgtctaaatcacacacgtcactgctgtaatatggtacttactatcccatgaaacatccacaaactagacactcagaaagtggtgttggaataagggaggttctatggcccttcttctcctgccccccacccatgcgccgcccaccattcctttccgtggaccactgaccttcaagtttgaacacagaacgggcaagtggcctttggagctgagggtgggacgtggcctttggagctgagggtgggtcatggcctgttgagaagagcagggccaaggaaggatggaagcctgagagacactggcagggggtggagaaaggcctcctctctgcctggcacctcattcattcacttatccattcattcattctccaggcccagccccgcctgtgggcctatggtgccacctccagagcatggatcctgccctctgagctgttgttaatgacttagatttatcttccgctcgggagctctcttcctctggtgtaagcattattcttttagtattttttcagtgcctggcactgtgctaggcactagggatccacattacggctaaagcatcgtccctgcccctgggggaggctcttgagggaaacaggcactgcacaggccattgccctggagcacagaggtgtggcactcagctccttgtggggtttaagaaaagggtccctgtaggatgcagaactcattgtctcccctgcaccccaataaaagaaggaaggaaaaggaagccgtgctcttctttctacattccatggcttcatcatggacatccacacagtgacccagctggacaagcccaaagcctggcctgctcctggacggcaccctctccccatcacatagctccactcagaaatgcttcttggcccgccgcaacttccacaccctggtcctggccaccagctggtctctttggggccatttcagtccctttccagtccctccaccaccctgtagccagaatgagcttcataaataacatggacccatgaccgggtcacttccttgctgaaaacacctccgtgtcagccctccactgcctttaggatcaagtccctgtgttatacaggtagctagccatgagtggggcaggtgagggctcttccccctacccactggaaatgtcgggtgacggttcagcagttatcgcatcgcctctctaaaagtagtgccggcgccagacagaggccagttcctgacggtccgtacctgttaacattaaagtgttgattaaaggcaggccccaagggagaagcaacttcctgggcacgcacattaagagacaaaaatgctgaagtattttatgatctcgcggacacacgccactggaaaaagggaaaaagcctgaggtgggcatgcgtacaaatcccacaacacactgggcaggtgcagttctcaagggtaaggaggacacggtgcgtgcagaaagcccaccctaagggaagaatcatcggaaagatgtgagcctataaagtcccagggtcaaggggaaaggcccttttttctctttctctttgaccttcaggtgcccacttggatctcttccaagggttctttcctattctaaaacctttttttaataaacttacactcctgctctggaactcacctcggtccccctttctgccctatacccctcagttgaatgctttcttctgaggaggcgagaattgcagttactgcagacgcgtacagattcgccaccagtaactcggggtaacgaggatctctgccaccgctgacacctgttccttcatgagatttagaaagtctcttctgtaacagaaaggtacaaagccgagccaaaccttgtgagtggcaaagcgatccatcatcagtgatgtagtttggatctgtgtcccctcccaaatctcctattgaattatcatctgcggtattggaggtggggcctggtgggaggtgattggatcctgggggtggattttccatgaatggtttaacaccatccccctggtgctgtcctcgtgatagtgaggagttcttgtgagatcgggctgttttaaagtgtgtggcacctcacactctctctcttgctcccgctctggccaggtgacgtgcctgctccccctttgccttctgccatgattgcaagcttcctgaggcctccccagaagcagagtagatgccaacaccatgcttcctgtacagcctgcggaaccgtgagccaattaaacctcttttctctataaattacccagtcgtctcaggcatttctttatagcaatgtgagaacagactaatacgatcagcaaagccaaaggacaaatgacacactagggaaaactgtctccaactcctatctcaatacgcaaggaactcttacagagaaaaggatgaagcacccagtgggaaaaatgggtaaaggacgtgaacagacagtgaacaagaaaggaaatacaagaggctcttgaacctatgaaaagatgcacatccccagacatgcacatcaaaagacactgagattatcccttttggtttgttggtttgtttgtttttactgattcaatgggctaaattctaaatgtcagatcacacagtgttggtgagcctgatgggacatagatgcccccactggttgttggcaggagtagacattggcacaactcccatggagggcagtttggcaagatccattaaaaattcagatgcacagaacctttgatccctccactgtgtgggaggaatatccagccgacagatgaaccctctcatagatgaaagaaatatgtttaagatcttcttcagtgcagcatagctagtgacagcataagactgggaaagttccaagtgtccagcccggggagagtagttaaatgaccaaagggagagtggtattatctcaggacaggcaagagtgatgggaaatgcagatgccactgtccaggaatcaagtcgccatgatccttcatctctgtgttgtgcctgcggggtggctttcgtgccacgaccgcagagttgaggtggcaaagctgaaaatattgaccctccggccctgcccagaaaatgtttgccatcccccgccttccaatgactctgctcctttttgtctggaagtgcttgtccctgcctggtattgcctgcgcacccctgtcctcagcctgggtaactcctactcgtagtgcctttctcgcttaaacggttcccatgggacgccttccctgcccactcggtaggggcaggcgcccttgccgttgcctcctgtagtcccgtggcttcccccgtttgggatcttagcacacatcccactgacttccagctgctgctttcgggatcccctctggggggctgtcatcttttgtggcacaccttgaccgggggtgttttgtaatcccggctcccagccgtcttattggcgtagcgtgggtgctcccaaagtgcttcttgaatgaatgaatgtgtctctgtgctcacattacacaggctttcagctagataaacaccagaactccatgttgtggccgactagagtaactcagtttacgttcctgcttcatcgtagactggaaaagaaatagcaaatgctcctgcttgtgcacactccgattattcttcccatctagcatgagccaatccctaggacaaatatggttttgggctccacgtgcgtgtgtatatttttactcagcaccgagcaccgtgttgggggaagggggacttatgaacgctgcagccagtgggagagcagagaggagtccccacaggcccacgcagcagcggtgagccccgccggggagacgagactgggtgtgcgagttggggctgccaacagagccagtgtgcttgtaggttccaaatccacatgctggggccgtgagccgggccaggtcaggtcagatagctcagctgagcattctgggtacgctagaagaaaatactttcttttccgtgattgccaaggaatggatgtgctcaagtaacttctagcaggtcagtgacgtgcctatttccgaaggccctcccgcctctcttggttcctccctgtggttgcaggaggctggctgcgggccacaggtcgagctggccctggataccgagagcctcgcctctgggatgggccgcgggccacagacattggcgcctggtgactctctctggtggccagcgtcttcaggttctcgaatcccggtggtggaagtccctcgttctggctgtgacatggagtgtcagtgtgccgaaactaagatgcttggccagcttttcttttcctttctacaattttaatcgtggtaaaatacacatcacataaagcataccactttaatataccactttaaccattttgaaatggacagttaggaggcgttcagcacattcacggtgctgtgcagccatcaccaccatctgtcaccggagatctttgtcctcccaaactgaagccctgtccctgttcagcaccaactccccgcacccctcagcccaaggcaaccaccattctacttcctgtctctgaatttgactactctaagggcctcatggaagtggaatcttacagtatttgtctttttgtatctggccgacttcacttagcataatgtcctcaagggtcatccaccttgtagcttggctcagaatttcctgcctttcgaaggctgaatcgtattctgtcatgtgcgtggagcacgtttgcgtatccatccatggatgggagcttgggctgctttcaccttttggctactgcgaatagtgctgctatcggccaggtgcggtggctcacgcctgtcatcccagcactgtgggaggctggggtgggaggatcccttgagcccaggagctcaagaccagcctgggcaacatactgagacatcctctctgcaaaaaataaaacgggtagctaggtgtggtgatgcgtgcctgtagtcccagctacttgagaggctgaggcagggggatcacctgagcccaggaggtggaggctgcaattagccatgaccacaccactgcacttgggcctgggcaacagagtgagagcttgtctcaaataataataaataataataataataataataaaatgttgtcaaaatggatgttcaaaaacccctttgactctgctttcaattttggggggtattacctaaaagtggggttgctgggtaattttatgtttcattttgtgaggagccatcataatatttgcttgcttttttaaaataaaaataaaaataaccaaatctctccccaactttgaaatagaaaataaaattattttactaaacaaagtgattgattgttttgctctgattcttccccaggtcctattacaatgacaaagtatcatcatggaaataacatagagctcaccttcggaagtcaggctccagctgggaccatggatggggccagggtgcctgtgactgcccggccagagaaggcacccttctaggggtcttgtgcatacatgtctgtttccagggaagggcccttcccccttctggttctcaaaggggttcatgatccccaaggctgaggacgtgctgggctaagggacgcctccgtcaggcccaggcttgggcttggagggatgttattccgctccttattctcttctttcttttagtaactttgtacgaaatttgcctttgatcctcttgtcaactggttttcccatgaaatcagtccttctgcacttgtggaagggtgggagaggctaggttttctgatttcgcgtatgaagggcactctcttctggtgactgtgagaactgtgaccatctgtctgtttaccttccattgtacgttctccgtttgttctccctctccattgtgattcggactttctcttttctttgcccctattgtgcctgtcttgctttacttgtcttctattcccagaagtttctgctctgtgggggcctttgtcctggagggaagatttgagagttaattgggtccggtctgtttcagcgcctttagaccttcagggtgatgatgagccctcccttgcgtctcctctgggagactgtgggctcctggatagtgggggcattggcccctacctctctgtgtgcctggtggctggcacaggggctgactccaccctgagatgtctgtgaagacactggcccaccagccccactcaccacgtgtgtgtctcctggagcaagggctcgttcaagccaggggcccctccttggtaacaaatgagagaaacaggcctcccccacctccccgaggtctccttgaccctccgcacccccgacccctgagcaggtttatccaagagccctggaaggccttttgtcactaggcctgctgggggcccaagtcaccatggggcccacctgcaggcaggggagtgtggcacttgcttctccttcccgccgtctctctccctctctgcccccaggcccttctgacctctgcagcttcaccgtccagcccccaccaccccccagcattcccctccccttcagaagccacttaggctgctctagccattagtgggcccaagagagctgcagtggggacgacacagtcaaggcatggaggcaggtgaagggcgcagtggaaggtgacgatagaggcgtttgtggctggcaggctctagcatttcccagcacacgcatgagcaaggggcagtgggaatctcagccagattaagggcagcacgtgcggtgctttatgcagaaaagagtctgggtgatgaagaacaggctgggggtgttgggtttctatgacgcctgggtatctaacatacaatgatcttagcctgaaccttctcctggaagaggtggacagccagttggatgtatcgctttctgctgttgatggggtcaagggccgggagaagggaggtctctatgatttacatggtttgaaaaagaaggaatggttgagttatactgactgggctccagttcacagacagcatcccgagagatggctcaaaacacaggactggacaaaaagtgggtcccattttcaactctggtgcacgtcctgaatgtttcattgcatctgcaaagtggaggctgaactaggtgagtagaaccgtaaggagacgggcaagagccatccatgctctgggctgaggagcctggcctgcgtgaggaggggcagtggtcatgcccagttaaatttggaaatgcatgggaccccttctactcaagatagccatccttaatgggatgtttgaatttaactgggcttccagtgtttttatttgctaaatctggtaatcctagcagtgtagtctgagagcatgcacttcaaagggactgggtatttttcagggaggattgagggagaatgatgtggaagccactgtgagaagcaaggaggtcacctatgccacctccaggccctgtgctccaaggagggtggacaagaatagccctgctggaaagggctcagaggatgcggtatccgggggtgggggtggggaagtcctgtttccatgacagcatgcaagggaggtacagaaaggagtttccaggaatgttggcgggcggcaaggctggggggccgtctgtggcaggacacggggctctcagcaacaggatgctgagctctgttgggcttctccaaaatgagactgggaggctgtcccatctggaggatgcgtggacttcacttcagttcaaggaggagacctattcctcccctgcagcctcaggagggtgcctactcaagacagtggctaccaaatgtagacaggcttccactgaatgtcattgccctgcccagtggcttgctctgaaaccttattgctcatcacacacctaaaccctttgccccactgggtagccttgccagccttactgaaaatcaatgatcaaacatggaggtgtttatttctgcactctcaattctatgccattgatttgtatgcctagatttgtggcagtaccacactgtcttgactgccatagcctcatagtaagttttgaaactgggaagtgcgagtcctccaactttgttgtttgtttccaagattgttttggtttcagagtcccttgcaatcccataggaatttggggtctgcttttccatttctgcaaagggctgttgggattttgagagggattgcatggaataagtaggtaaattgggggagtattttcatctccctaaacaataacaattttatattatagcaacattacatcttccagtctatggacacagtatggctttccatttgtttaggtcttttatttctttcaatagtgttttgtggttttcagtgtacatctccctggctaaatttattcctgagtattttgttctctttaaggctatcgtaaatagaagtgttttcttaatttcctattcaaattgttcataatgtgtggaaatgcaaatggatcttgcatattgacctggtatcctataactttgctgactttgtcattagctctgatggctttgtttggtggattctttgggagtttctatatataagaacatgccatctatgggtctaggtcattctatttcttcttttccaaattggatgtcttttgtttctttttcttttcttttctttttttttttttttttgcctaattgctttggctacaacttcaagtaaactgttgactagaagtggtgaaagtgaacatcttgtcttggtcatgatcttagggagaaagcttttattttttcaccatcgagcgtgattttagctgtggatttttcatgaatgacccttttcatgtttaggaaattctcttcttatttttctgagtgtccttatcatgaaagagtgtttgattttctcagatgctttttccacaccatttgagataatcacgtggtttgtttccttcattttattaatgtggtgtattacgttgtctgattttcgtgttggaccaccctcacactgatctcacttgcaataaatctcacttggtcgtggtgcataaccctgttactatgctgcccaattttgtttgctattactttttttttctttggagatggcatttaactccgtcacccaggctggactgcagtggtaccatcatagcttactgcagtcttaaactcctgggctcaggatatccccctgcctcagcctcctgtatttgctagcatttttttgaggatttttaaactttgttttcataagggtcatcgcctgtagttttcctatggtgtctttttcttcctttagtgtcatggtaatgttggcctcatagaaggagttgggaagactcccctcctcttttattttttggaagagtttgagaaggagttatgttaattcttctttaaaggtgtggtagagtttactggtgaagccacttggtgctgggcttttatttgttctgagatttttgataacaaaaccaatctcttcacttgttataggtctatagagaatttctctttgtttatgagccagtttgttagttgtgtgcttctaataatttgtctgtttcctctagattcattcttaatgtaaaattgctcatgatacactcttagagtctttttttttaatccctgtaaggtaagtagcaatgtccttgctttcatttctgatttagaaatttgggtcttctcttcgttttcactatagaagtggtattacttctttgttcctgtattgtaaagagggagcagcttagtaggctcccatatgtacctttctatgtaatgttgcttgaaccaacatgaagatgatgcaacatccaaagtacatcactgacaactaggtcctgagggaaacaaacttgggatgggtccaaagaactatcggatccccggttagaagaactttagacagaactgcattatttatgttggtaaatagccacaggttttctgggagaatgtgtggctgagtgtttctgacctccacttccatcaataagctctgggcctatgaactgacagatctggaccctcggtgggggaccacagttttccacggcagctgctaacatcagccttctgcttgccagctcatgttattcttttaataaaaatcaagtaatagtccagtcagctgtccttacatgcaggccctgagatactacaatctgtaacgttgccacaggtccctgttcatcaaatgagcctgaccccaccctgattgtgctgcccagtacgacagtggtgcccacctgagccctggtaattttgtgtcaccgtctggaccctgccatttgagaatcctctcattgcctgccagttccatggcggcgtcgcttgcttccaaccattgttttgagaggagtcaaagcagaggctctcaaagatgccggggccaccccactagcaaattcctcattttagagtgtcttctcagccctcgaaggggacaacattcacaggtagggccactggtctcacataatgaatcacatctaatactgctctccgctcaaccctttcaccaattggtcaatattctgccaaggcagttcccataactccatgtcatttactgtaggctgttgtccaaacgtgaagctgccagcccagcaggatctgaggccagccccaagacagggaaccccaccttatagctccgtgctcccacgtaaatacactctcccctatattgaactgtattctgtctgctgtcttgctggttccgcatgcccaaaatccattcccacctatgctgtcccaggtcatgccaaggcgaactagccagcttctgcagcttatctgaatatgaggtatttcccacccaaacagaaaccgtatttctcttctgtgctgtgatctttcctattcaaacttcgcgcttgtcagagcgatgaaagttagcgggatggatgttaggtaagacaagcaattttttttcttagagactgggtcttgctctgtctcccaggctggagtgcgagggtgccatcatacctctctgcagcctcaacctcctgagctcaagcaatcctcccgcctcagccttccgagtagctgggactataggcacataccaccacgcctgtgtagtttttaaatgtttattattgtggagacagagtcttactatgttgcccagactggtctccaactcctagatccaagcgatgctcctgcttcggcctctcagtgtgctggaattacaggctcgaaggcaacttcctttacggcagctcccttggacgaggtctttacagagcctccatgaataaggggattgctccccaattagcaagggttaggtggttgctaatgccagggtgagggttcaggatattctaggtattcaaaattctcatgggcatcactcttacaaatctgagggttcccctctttccccatcagttgcttacttggatatagagacctacgaatgtggtgtgagccgtctctgtgtgtgcagctctgccaagcaacagttaagatcagggcctgatgggcagcagtcttccttctgactggagaagaggaggtcaccttaacctagcgggccagggtgggtgacaggctgggctctgtcatcaaacacacaggcacctgtgatggaggtccagctgagggcaatcatggaggggccgcagcacctgctcaggctggaaaggatctcagagtctatatatccttcaacccacacacgtgccccggatgcctttcagtgaccctgattcaaggaggaggagaatagatgcatgtccgaggcatgtctgcctctcttcagtggatgccccaggtgtcagtgacatccaagagagaccaggtctcctcccttcaccccaagccaacaggcacctatgacctcacatagttgggtgaacctggggctgtgctctcaaaaacaggccgtcggcccatgacactggtgagaatttctcactgacagagggaagcagtgcatccttgttaccttaaagattaggttgtcacctgagtcaccacattcccgtctgtttctatgtcacctgaagtcggtcttcagagcagagccttcaaccacacctcacttgctctcccgatctagcatgaggtcaggaatgaatgaatggggtaggaaagtaatattagaagctagagataaacatggctccatgagaaagctgaactcaggtgatatgttggactcggggagacagtgttgtggagtaactaaagtgtgttgtctcggtgtgtgaggtccacacacagcacggagacgatctgtttccaaataattgccggggccatgaggatgtcacatggactgcccaggcagtgtgcccaggagtcttggtcacactcaggcagagtctagagagggttccgtcgggtctgatgtatacaccacttggaaggctctcttctaaaatttcgtcagaatttccaagctattattgctttggaagtgtgtctatatatttcctagaccttccacctatggatttggacaatctcaagcatgacacagctgaagttcaaggtgggagacacagtggttttaaggtgactccaaacagctcctctgccaatgtcgccccaacacatggccatgtgaacacataacatggtctcatgagaacaggtgacttcctctaagaactaaaaaaggactcaggttcatgtgaaggccttcacgtttattttagcatcaagtttgaaaaacaaactggcttttccataacacttatcctcaaaaaccatcttgtttcaagttagcctagcaatctgtgggcttcacaacttaggtctgaattgcatctgtttaatattattccaccaagggccggccccacttagcggaatgaaggctgcccctgtgacccatttttccaactcccagccctggcgcctctagcagccgggaatggcttaccagcctgtgtctagattgttgggacctgttggagccggcccgtgaataagttggaagatgaagcttggtgacattgagacaaatggccacgtcttgggggattctggatccagaacaaggagctggctttactccagtttacgggcaggtagacgggctcctaagcagttgggccagccacacaggtggagagaagccaggccaagaaggagatggctctagctgccctccacaggggaccgacagttagagggagaagatccatcactgtcagttatgaagacagcctgaagcctgttctaggaaacagttcagccgttgaaggagggtgtggaatttcagggaaatgcagagcgacaatcttgcatgaggctgacaagacgctcactgcacactgagatttcactcaagcacatatggactacgtgcaagccattcggtaacttcatgtttggcctgcagtttgctttttgaaaaagtatcggaaggtcgtgttaacataggagaaaatgactctctcatgggattcaactctcggggctacttttcaaaaaataaacaagcctagcagggaaaaggcaggaattatctgaaagaggaatctgatggtttctatccacgtatcgccaaaagaatgaaaagtctcactgacgtttccataaaaatatacattaggctttaaaaattattgttgtttaaaagctgataccagtggctttttgtgtaaaagaatataggtcctaagtgaaagtaccaagtccagtcaaaagacacgttatgaaaatcaatgctcttgtctttcaaacctatcgggacaactacacatccaaagacgttgagggaatcgcaaggggttgcaatcgtttaacaaaatagctcttcacgagtttgcgatgaagacctggtgatgaatgtgccaccagcacatgcgagagatgggccccaaatgaattcctcacattcccaaagtctcgaatatccagaacatacttacacgcgttggggaagggaggaggcttcctcattaattctagaaaggaggcagctccctgggaaggtatgggtgcgggggaggcaggcgggagctaattagctgtatgggtggttgctggttctcttcttgccttctttaagatatttctgtcaaacagctctttctcccggtaatgcacaggtggtcctcgcaggtacttctcctctgctgccttgtaatccagcccatcaagtgcggcgatggtacaaatcatggcttccggcagaagaacttccagaacaaaattgactttgtcatcccttatcagagtcagcctggccttgtcaatttgcttgtagatttcttgtaaatgcttggccacgacttccaactgatcgtcatcctccaggtatgtttcaatgcagtgcaaatccctgtgtggcttcagaaacgcggtcagccacctggactgcttcctgccttgcaagatgtccagaaggtgggggtcggccccctttctcctcacgatgaagtccacgagcttctggttgtctcggtcccaagaggccctcatccggtccgggaggattttcttgcaaggcctcttcccgcccagggaggtctcctcctcccagtcttccaggtcgccataattcacctttggaaagtcaatctgcaggtctccctcttggatggctctcctgattgggtagctgatgtctgcggcataatagtccaggaaagagccccggaaagaaccccggaccagtccttctctgtagtgggagatcagtgagaagcaccagttgacgctttgcttgtaggccttctgggctctcttcagcagtttctctttctccttacaatccaggtgcttcagccttcgaagaggaacttgaatgccccgctttccatggtgcaggttggcctcaagcaggagcaccctcgcggtcttgtctgtgttgctgacactcttgaccactgctggccaaaacggatgatcttgaaatttgaaccagaccatcgttcccctttcgatgggatgtggctcctgtggaaaagcaaggctggggggctgcccatcctgtttaccgccagccctttgaatggtggtgacaggattagcaagcttagcgtcaccaggcgtctgaggtccttgaggtctcctctgaaaatctggacctggacgcttcctttttctattggcaagccggagtgaagaaggcagcctgtgctgacgggacccagaggatgcagccatacctgcccagcctggcttccaggcaccctctccggggtcctgaatgttccccgagaagggagaactttccggggatgcagccagggccttcttcgggcggctgtcctgtgtctcttccttcagagtggggggtgcagggctggtgagacctggaggcagagatgcaccctcctccgttactgtgggaggcagggacataagagttgaggcgtttgcccttttcttcccctttttctcacaaacatgccgcgaaagcgtcagggaatcctggcaggctcgggggctttgcaacacatgtgcttgcattccaactggagtaggagcaatggccatgagcgcctgtgacctgtccctgcccagggcacctggagtaggatcaatggccatgcacgctggtgagctgtcactgcgcaggacacttggagtaggatcgatggccgtatgtgtctgtgacctgtcactgtgcagggcgcctggagtaggagcaatggccatgcgttctcctgagctgtcaccacacagggtgcctggagtctgagaaatggcttcgcgtttccatgacctggtaccatgcagggcccctggcataggtgcaatggctgtgtgaaatggtgagctgtcaccgcgcagagggcctggagtagaagcaatagccttgtgtgcctgagagccgacacggtgcagggcgcctagaataggagcaacggccctgctttctcttgagctgtcacagtgcagggcgcctgaagtaagagtaatgtcctggtgcgctggtgacctgtcagcatgcagggcgcctggagtaggagcaaaggcggtgcacgttcgtgagctgtcacagtgcagggtgcctggagtgggagcaatggccttgcgtttccatgacttgtcatcgcgcagggcgcctggagttggagcaatggtcgtgtgcacctgggagctgtcaccatgcagggctcctggagtagaagcaatggccgtgtgtgctggtgacctgtcaccatgcagggcacctggagaaggagcgatggccttgtgcgctgatgagctgccaccgcccaggtcacctggagtaggagcaatggccttgtgtgtctgagaggtgtcaccgtgcagggcgcctggagtagaagcaatggccgtgtttgctggcgaactgtcacctcgcggggtccctggagtaggggcaatggccgttgagctgtcatcacccagggcgcctggagtaggagcaatggccctgcatgctggtgacctgtcaatgcgcggggcacctggagtaggagcaatggccttgcgtttccgtgacctgtcagacctgttaccgagcagggcacctggagtagaagcaatggctttgcgtttccgtgacctgtcagacctgttaccacgcagggcacctggagtagaagcaatggccttgcgtttccatgacctgtcacctctcagggcccctgcagatggggcaatggccatgcgagctgttgagctgtcaccgcgcatggtgcctggagtaggagcaatggccgtgtgtgcctgagagctgtcaccgtgcagggcgcctggagtagaagcaatgtccaggtgtgctggtgacctgtcaccatgcagggcgcctggagaaggaataatggacgtgcgccctggtgagctgtcacggcccagggtgcctggagttggaacaatggccctgagtgctggtgacctctcaacgtgcagggtgcctggagtagaagcaatggccttgcatttccgtgacctgtcagacctgttaccatgcagggcacctggagtagaagcaatggccttgcgtttccatgacctgtcacctcgcagggcccctggagatggggcagtggccgtgcgcgctgttgagctgtcaccgcgcatcgtgcctggagtaggagcaatggccatgtgtgcgtgagaggcatcaccatgcagggtgcctggagtagaaggaaaggccatgtgcgctggtggcccgtcaccatgcagggcgcctggagagggaataatggacgtgtgggctggtgagctgtcaccgtgcagggcacctggagtaggagcaatggccatataagtccatgacccgtcaccgtgcagggcctctggagtaggagcaacgaccctgcgtttctgtgacctgccaccacgcagggcgccgggagtaatagcaatggccctgcatttccttgatttgccaccaagcagggcgcctggagtaggtgcaatgcccatacccacccatgacctgtccccgcacagtaaacatggagtaggggcaatgctcctgcgtgcgcgggacctttcactgcacaaggcgcctggagcaggggcagtggccttgctcacccctgacctgtcgccgggcagggctcctggagtagaaccagtggccgtgcattttcgtgacccgtcacagtgcagggtgcctggagtgggagcaacggccctgcgcaccggtgacctgtcacggtgcagggcacctgcaggaagggcaatgcctgtgcccacccgtgacccaaccctgaacagtgcggatggagtaggtgcaatggccctgcctgcctgtgacctgtccctgcgcagtgcacctggagtaggggcaacgcccatgcccacctgtgaccccttcccgcacagtgcgcatggagtaggggcaatggccctgcgcacccgggacctttcactgcacaaagtgcctggagtgggggcaatggccctgcttgcccctgacctgtcactgcacagagctcctggagtaggatcaatggctgtgagctctcgtgacctgtcacagcgcagggcgcctggagtaggagcaatggccctgcgcactggtggcctgtcacggcgcagggcatctgcaataggggcaatgcctatgcccacccgtgaccatatctcgcacaatgggcatgtagtagggacaatggccctgcgtgctcgtgaaccgtcaccgcgcaaagcacctggggcgggggcaaggctggtgtgcgcccgtgacttttcaccacgcagggtggctggagtagaggcaatggccctgcgggaccgtggcctgtaacctcgcagggtgcctggagtaggggcaatggccgtgcgtgcccgtgacctgtaaccgctcagagtgcctggagtaggggcaatggccctgcgcactggtgacctgtcacggcgcagggcatctgcaataggggcaatgcctatgcccacccgtgactatatctcgcacaatgggcatgtagtagggacaatggccctgcgtgctcgtgaaccgtcaccgcgcaaagcacctggggtgggggcaaggctggtgtgcgcccgtgacttttcaccacgcagggtggctggagtagaggcaatggtcctgcgggaccgtgacctgtaactgctcagagtgcctggagtaggggcaatggccctgcgcgtccatgacctgtaacctcgcagggcgcctggagtaggggcaatgtccgtgcgtgccgctgacctgttgccgcccagggcgcccagattaggtgcaatggcggtgcctgtcgttgacctgtaaccgcgccaggcacctgggttaggtgcaatggccctgcgcgcccatgacttgtaacctcgcagggcacctggagtaggggcaatggccttgcacgcagatgacgtgtttccccgcagggtccctggagtagaagcaatggcgctgcgggcccgtgacctgtccctgtgaagggcgcctggagtagggacaaaggccgtgcgcgctgctgacctgtctccacgcagggcacctggagcaggggcaatggccttggacacagatgacctgtttccctgcagggtccctggagtagaagcaatggcgctgcgtgcccgtgacctgtccctgccaagggcacctggagtacggacaatggccgtgcgtgctgctgacctgtctccgcgcagggcacctggagtaggggcaatggccctgcacacccatgacttgtaacctcgcagggcgcctggagtaggggtaatgtcctttggcacccgtgacctgacaccgcacaggacacctggagtaagggcaatggctccgcaagcccgtgacctgttgccgcacagggagcctggagtaggggcaatggctctgtgggcccgtgacctgccaccgcgcctggcgcctaaggtagggtcaatggccctgctcgcctgtgacctgtccccgcacagggagcctggtttgggggcaatggacctgcatgcccatgacctgccaccatgcttggtgcctcgagcaggggcaatggccctgtgcgcccgtgacctgtcactgtacaggcagcctggggtaggggcaatggccctgtgcgcccaagacctgtaacctcgcagggcgcttggtgtaggggcaatggccctgcgtgcccgtgacctgccactgagcatggctcctggagtaggggcaatggccctgggcgcccctgacctgtccccgggcagggcgcctggagtaggggcaatggctgtgggctcctgcgacctgtcatcccgcagggcacgcttactctctgaagggaccgtcggtgagcttgggttttccctcttcccaagactcctccttaggtcgcctttgcatctccagtcatcttcacgagggacagaactggctggcttttcgggcaccttttgagaaagctgagagggtgtggtgctctctagttcatgtggtttccttcctccacccagatttgttctctctttcagaatctccagggccacccgaagggttcctctgtaccccatcttctctctgagtggggcaccgagcttcgtctgtgctgctgcagaggcggcaatgtcttccatctcaaacttagttggggtcttcacgtctgtgcttttcaccttgattttttcatctactgcgaggatttgaacttctagagaaatcgccttttcaggcttcgtttttggtgaagtcccacgtgtgcacaaaacctttgctggccatagtcggcctttccaagagcataggacgtactccgagtccatgatgagctgggaaaaggtagctaagggaggccgaggggtctgcctgccacaccctctgctaccgtaggtctctcctaaaccaagctactcttcagagcatcctttgccttcagactgcaaagggggtgcagtgtgggtgggctgtgttcctcctcctgaatctccctgaggcacttgaactcgtgtttccaatggacaattctggagtatgctgcaacatggtaaagggagagcggaaatgtatcaggaaagcatcctttcgtgaaacgcgaagcaccctgctcagtgaggttgataaaataaggaaacgtgacaagtgagtcttagacagagggatagacagatggcaagtatttgggatcatacagaaggtccacagaagctttattacacagcaaacccaaggccttctcctaattttaacaattccatcttgaggagcacctgcatggggaggtgggtgtaccagcagggaccccacatttcttactgagtattctgtgcctttgggctccttgggcggaaacctggggaaatgcttcatgtttttatttctagggtgctagtatggacctgtgcttcccaggaagcccgaggaggtctcccacatgcagatgctgggtgtcggcaccatgtcatgtgcaagagcacccagaacccagagctgcgtggcgatcatcctggtgattactggctaccatcggtcgtgaggatcgctgcaggcagcggtcactggctgccatctgcacctctctaccgtggttttaaacttttgcctgccgacaccaaatcagtgactcttatcctgaaaacaagtgtctgtacaacgatgggcaaggaaaattccactgtgaaatgtcagcgtgaggtgaatgcaagtgaatgtttagtaaatggggaaatcttacccagtgtcacatggatcgcagcaggtttggttctgtgagctggatctcttgctgctcacactgcaagcgctggtgtgcagacccttcaaccccactctgtgcccctgaagtgcgctgttcttctggcgacccagtggcaccgcgtgtagatgctcaggacctatgcactcctaatgtcaacctggaaacacaaacacagataggaaattaagccaatcaagtgatttatcctgttcccctccccaactcttgaatgcatgcccttttgaaacagaactgacgtcttcatctcaggcatcacgtagttgtcatctttgttttctgccttcttttgcatctcaaacaatttccctgttatgccacttagcgtatgctagtctttttccatttcagaaccttgggaactagtgctttcccgagagcatccccctaagacagaaggattccatgttagcagtctctctctctctctctcctctctctctctctctctctgtgtgtgtgtgtgagagagagagagagagagagaaatgaaatgtgctcaacgagattgataaaatgaggaaacatgacaggtgagtcttgtcatgttactgtgtttttctgattctcaaataacatgaaatgggttagcatagaatatgagatgtgtagacagacatatgaaaggacatcacgtcacagaatctcagtctacatgataatgtgcccgcttccaaggcattgccgatgcgccaatgtgcacacacacatgcacatatcatcttcaactggagctcctaacctaagagcataactggatacattgtcctgtgaatgcccgtgttcctacctcatttgtgtgaacgtctgtacagtgaggtttccctgctagttccaaactttatttaatgaaatgtcccatattatagaaacgtgcaccgaagatgcaactcttttgtcaatccttcacttcccaccttccacatcgaaatactctgctagcctgttgttgttttctatagccattgtacaatatttggtactgtgcaacattgggtatcatagctcacttacatattttagctcatgcattgtggacttcaaattacaggtttcataggccaataattattttcttaataaatgcatgtatgtgtgtctttgttcacgggcactggtagatgtaatatgaaatgtataatgatgatgagatatacatactttagggaaaagttgtacaaaacctttcttagacgagggtatatgaacgtacaggtttaatgccctcttctttagagaactcagagtactgggttgtcaagcacaagtgtcaactgaggaccccgaacaaaagtgagaaggaatcaccaatgaccctggcacttcaatctccccttaactggacctgccagcccatgtcacaaaacaggtgtgactgggcaccctcaagcccaagtcaatgcctacccacatccccaaatgcagagtctctcctctcttcctctctctctttctctctctctctctccacacacacacacacacacacacacacacacacacacacacacacacacacgttggaaactcaaggagcctggcattgatgcatagaatccatgctcactgcctctacacattcctgcaaatgtttctgcttccagtacaaatgctgttttcttctccatttagtttcttattttaaacatagacagggaaacatctaaagggatgtctaaaatttctaaataggaaatatagtaagcatcagcaatcccatcacccagaaatgcttattgcaagtatatgagtccacacactccagaatttttgtcctgtttatacatgtatatttctacaagatatttaaaagcttaaagtttgcacagccatttgaatattcttcagtattggcatctggcaacatctttacaggtgtgaaacagtttaagggactgcctcctacagaccaccaaaatatccattgcagctaagttcggatggccaaagccatgcctccttaagagagatcatcagaagggaagtgtgtgaaatcaaaatatgaaatgttctctcaccacatgcgttggcccatcgcccaaataccttctatcaagggtttgcatatagtcttgctggtgactttctccccatattttgtactaagggaaacacaattgttttccctccctctagagagagagagagaggtaggtaggtaggtaggcaggtagatgggggatagacagatggatagacagatagatagatggatgcatacaggtagagatggatatagattgatgaggttgaatgactcatagggatagataaaaatagatggataaaagatagagatagataaagatatatattagctagaaggtctatagatattcagaataatagagagccagagatagagacatagatggtggagacagatgatgaagagatatatagagagaaagacagttggatatagagatagataaatataattttatagaagatagcggcttgatagatatgaagaatgataagaatagataggtgatagatggatggatagagataaagatagagatggatgaagacagagagatgatggatggacagcagagtggctagagatagagcaagatagctagacaggtctacatctatgtctgtctaggtttacctttacctgtctatattgcagatccagctagatcacgatgtgcaaatattgatctacttccgcataccgggatctatgagataaaaagggaacattcactaagcccaactcagttttgtgagtgaacccaagttctcagactattgagtgagtaggacaatgtgttgaatattttacttcaaaatgaaatcaaacaccacctgcacaatgagactaagcagatgaacataaaaggaagacaggataaatagtgagtctacaatctataacatcacagtccattttaggtccctaaagacattatcagtagagcattttctatttttggtatataacttttattctattccatttgctctttagttgagggatgaaggaactagaagaccgtgagcttttatttctcccaacgacagccatgatttgggggataattattttggaagccctgtgttaattcctttctcaagtgagggttcatttactttttaggaacaagtaaaagaacacagtcctcagcagctcttctcaaagtggggtccgtttcctgacgtggtccccctcccaccgagaggcatgcatcctccctccagcacccctccctagcattaccagagctttgtggagctcccgtcggctgctgggtgtgtgattttagaccttcccccaaacaggtgtttccttcaaaggatgagctggcggcatcctttagtacaataaaggcaccgtgtattaaatggtttctctaaaggaagtacattcttgtgtattcctacaccttccctttgcgctggtgaattgcacataaactttcaacgtaactttagagacaggtctacgctttcctagggtttgcagtgcacttgtagcaccattgggtgagaattggtatcggtccagttttccccttattctgttcactaattgcatgcatcagtagaggatgcaattagtgaacaattgcaccgctctccgacctggagagcagagccgtttggtagacaataggaacacaatggcccgccctggtgaaggagcctgtgtttttcgcttctgtcatcgagaaggggccctcactgattttcactcaattcacctcatcgtagttagcggagtgagaccaggaaattcaccttttacagaacatgggtctcaagggtcagctacgcaggatgagcccagcatgagtcccggcctgctcaaagtgacaggaggccttccagtcctacccatggtagctcctcatttgccggcatcagatttccctctcctaatgtatgcatcgtacgttcttacaatgaggaggcgagcaaatttccatcctgaaggagacctgcgacattcctttgagttcagaaatccttgtggatctctgctttaaaggactgactcgggtgacaatgctctggctcaacaggtgtcacctcaggacagtgagtcaggacagtcaactcaatgccacacacattcacacacacacacagagacacatacttcctcacacacacacatccatacacacacccccaaacacacacacatcctcacacacacacatcctcacacacacatcctcacatacaaacacgcacacacatgcacacgcatccacacacatccacacacacacccccaaacacacacacatccacacacacgcgcgcacacacatacacacatgtccacacacatcctcacacacacacacccacacacatgcacacaccgtcacacacacacacacagacacacatcctcacacatacgccctcacctcccccccgcccccgacacagtcacatcgatagcagacacctactagtcttgacgttcctacagctattccagctgtccgctctgtaaatatccttgcgatgtgtgtctgccgccaggaaagaaacgtttaccttggttgtcatagaaaccgaagtgtcgtcccgaggttctgctggatgacgacttgctacggagagcaggaagcgccaatacatcccccgaggctcagcgtcgatctggagctcactcagtggcaccccgctcaatctcacgcgggaaccaagaaaggattcgcaacagggctgggaattctccttggcctaggcgctgggggcaggggaagtttcacagaacgggtcatggagggaggcaagtgaaggcgtcacaggttctgttctcccttgaggcacagggacgtgggagccaggttccctgaggggccacctttcccaccgccagaacacacgagatcaggtacttttgtgtacctatagcttagctcacaccgagaacatgcggtattcggttttccgttcctgagttagctcacttaggataatggcctgcagttgcatccaagttgccacaaaagacacgattttgttcttttttttacgcctgactagcatttcatggtgtatatacacattttcttcctccactcatcagtcgatgggcacttaggtcgatgccacacgttggcgattgtgaattgtgctgcgataaacatacatgtgcagctgtctttttcacataatgacttcgtttccgttgggtagatacccagtcgtggtattgctggatcgtatggtgtatcgactattagttctttaaggagtctccatactgttgtccataggggttggactaattttgattcccaccagcagcgtaaaagcattcttttccaccacatttgcaccaacatctattgtttattgagtttttaatcgtggtcattctggccggggtaaggtgctatctcaccctggtgttcattggtgtttccttgatgatgagcaatgttgaacattttttcaaatatgtcttgtccatttgtatatcctcttttgagaaatgtctgtccacgtcatatgcccacgttttaatgggattatttgctctttctccttgctgtttttgtagagttccttgtagattctgcatattagttctttgtcgcaagcacagtttgcaaatattttcttccattcttcaggttaccttgttactctgttgataatttctttggcatatttctttcgatacttgtgttgttgtcaaaaatggacttatttttcatggaccatatttgtatgtaaacatgaatgggctgaagattatttttaaattgaaattttcatttaattgatagctcaggttttttcaaaacacttgaacatatattgcatgggtctaagaattgttatttttgaaagaaatatttattgaagtgaaactcagataacataaaattagatatttaagcataccgtttggtggcataaagtaaattcacagtattgcaaaatcatcacctctgtctatttacacaacatttgcatcaatcccaaagaaaaccctgtacccatgaggcagtcactactgattcccgcctccctccttccctggcatccactcatccgttttgtaatcagatgacatgataacaacctgatttctaagtatcgctaatccttaacatttgcttcttctggacattccatagaaatggaatcatagggtacgtgaccttttgtgtctggcctatttcacgtaacatggtttccaagttcatcccacgtcgtaccatgtatcagagcgtcattctttctcacagctacggagtatcccgttaggtggatccatcatgttgtgttcatccatttatctgttggtggtaatgtgggatgctcctatttggctgttgtccatggtgctgttagggacattcatacacatgtatttgcttgaatgtctgttttaaatttttctgcatgtatctaggagtggaatgatggtgtcatatgttcattacttttaacatcttgaggaaacaccaaactgtttttcgtagcagccacacaccattttacattcccgtcagcagtgtataaggcttgcagtttctccacatctttaacagcagcaatttttgtcttcctcttgaaagtaaacaacctggggggtggttagctggtaggattgtggtgtgatttgcatttccctaagagtaatgacgttgagcctatgttctccgtccctgtacccttgcacatgcctggatcctattttgcttattgcatgggccatcttttccgtcctcattcatgtgttaaactcctacccacatctcaatatcgatcagcaatatttagtctgctgagtgcttctctaaaagccagactctcaccttgatttctttgagactatgaacgaaacaaccaagcgtgatatttaggccgtcaaatggccttgagaaaattctacaccacgggcttctaaaacagtgagaaaatgttttgtcacgagtctaggtaatcagaaggagtaaattggcagtgatcaaggtggagtagtattagcaatgtgctgttcttagaattagcactgagatgagttatgaaatcttgatgtatctatggtacgtagacatctatgtattacctcttggagcacatggtgaaatctccagatattttcagactactatatgccttttccagtagtaacgtgccattgtgacggagatcaatctgaggcaatgtttaacatgagtaagtgaaacgagagataattttcagtaaagttactgtaggaaaccacattcaattatatgatctcacaaagagtctgtagtacagcaagggctctggcagcctttgcccattgttcctcacccaacacgttggtggcttgctatgagccagtgaaatgctgatggtcacaagcaagtgaattcaaagggaataggatacagtagccttacctttaacctgttactcgcacaggcagtgggaaagcacgatgagagtgaatacagtcttgaagactttgctaaatgtagatgaaagaaggaaaatgcatgattacaaacagaaagaaacttgcagagctggtagcaaacaaagacaggtacgaaagttaaagataattttagaagacgtaaagacaatctatagctgtatctatttgagtccatagctatgtctttatgtatacccacgcctctatctatctagagagagaaaaggatgaaaggaaataatacccgggattttaaatggaatattatatctgcttggtggaattatgtgtgcatttcatttcctttataaattatattttcataacattttacagtgaagatgtattacatttttaactagaacacagacttgaaagtagaatttaagttaccttagagagcctcatattatagtatttctttatttgttattaattttaatttttgtattttgtatataaatttatgggtacatgtgaaattttgttacatgtatacaatgtgtagtgattaagtcaggatatttagggtgtccgtcgcctgagtacaacacatttttgtgaaggaccgtcaccctactctgctctcaaacacggaattgattgcttctatctcactgtaggtttgttcccttcaacgcacttctctgcatccttctcctgctgactcactcttcccagtctccattctctacctctccattctctagctccacgcgatcagatgttttagctcccacatataatagaggacatgtgatatttgtctttttatgcctactttatttcactgacgataatggcctctagttccgtccatgcggctgcaaataacatgatttcattcttctttttaaaggaataatttgtgttccacacacacacacacacacacaaatacacctagatatatgtatacatatatacaccatcttgttaaaaaaccattcatctgttgatgcacactgaagttgattccacgtctttgctattgtgaatagtgctatatagtaaacatgcaagagcaggtatttttttaatatattgatttcttttccttttggtagatacccagtcatgggattgctgcatcgaatggtagttctgttttcagttttgttgagaagtcgccatactcttttccacggtggctgtagtagtttacactctcaccaacaggctgtaagatttgcctttgcttcttattcttgccaacctctgttattttgtgtctttttaaatagtggccattctgactgaggaaagatgatatgtcattgcggttttggtttgcatttctgtggtggttagtgaaattaggcctgtgtctctcaccgtatacaaaaatgaacgcaaatagattaaggagtcacataaaagagctgaggccgggtgtggtggctcacgcctgtaatcccagcactttgggaggccgaggcgggcggatcatgaggtcaggcgatcgaggccatcctggctaacacggtgaaaccccgtctctactaaaattacagaaaattaaccgggcgtggtggcacgtgcctgtagtcccagctactcgggaggctgaggcaggagaatcgcttgaacccaggaggtggagcttgcagtgagccgagatggcgccactgcaatccagcctgggagacagagcgagactccgtctcaaaaacaaaacaaaacaaaacaaagcaaagcaaaacaaaacaaagtaaaataaaagaaaacacaaaaaacaacctgaagctatataaatgctaggagaaaacctagtgaaaactctctttgacaccggtctaggcaaagaattcctaagactttgaaagcacaggcagcaaaaacgaccaaaaatagacaaatacagtgcatacagctgaaaagcttctgcacaacaaaaggcacaatcagcagagtaaagaaataacctattgaatgggagaagatatttgcaaactaatcacccgacaggtgactgatatccagaacatacgaggaactcaaacgactcgacaggagaaaaaggagccccttaaaaagtgggccaaggaactgaattgacatttcccaaaagaagacataccaatgtcccacaggtgtatgaaaaaagtgattcacatcactaatcatcggagaaatgggaatcaaaacccatattaatttattagtggaaagcagagggttctttattagctaacttctggaagactaactttacaaattcattaaatgcagcattcttagaagttagaaacttggtgtaatgatctgtagagggggagtcatccaatacctgtgttttcctgcccttagatgaaaatggaaatgtgtccattggatttactctcaaaactgtaatatagacaagttctactttgtgctagacatgccataaaatgatgtaattcagtcttgattatttgtggagtagagactccattcatatcctgtttttttacttctttctcatttttcacattttcaatagtttcgtaatctccatggactgtatttgcaaaaagaagacgatggtgtccaaaagccaccagatggaggcgttgagctgccattgttaatgtcagccaggcagtccctgacgcatagtgtgtgggtatgagaacaacctggataacttatttccaatgcagatttcacattccctcccacagagagagttcatttggtaggcctgaagagggccatgaaatccaaactttcccaaatccctttcactgtgaccctgatacaggctggtccacaagtcacactttgagaaactttgatttcaatggtaatggtagttatggccatatatgaaaataaatagagaaagagtatacagctggaagagaattgagcaagacccaaatccctggaaattccatcttgaaagggccccgtggagaaggtgctgctagaaaagatattgagacgtggccaagatgaagagaataacaggagaatgtgttgttatggaagacaaaggaagacaaaaggagggcactgagaaaaagaggagagtgctcaacagtgttgaccgcagctgagaatcaactgagatgagtgccagagaatgtgcattagatctagtcacatggaggtcaccagtgacttttgagggagaatccttttagaagagatgtgcgggcccacgttggcttctagtggattacagaaaatgtgagagatgaggcaatagaggcaccaagcagagataatcctttggaaactttgacacaaagagtaagagagtggtgggaattacattggtggtgaataaggcccagggattttcaagttgaaggagattcgagtatgcgcaaatgggaataagaaggatggcaagagaaagacatgcagaagatagagggaggagaaagataatggataaactaatggataacacgaggtttctggaagacaggaggccatggaacctagaacacaggggcagggacgtctttcctcctctaacagagggagagacagggcacagatgcaggtagcttgtaggtttgatggcagaagttttgggggatttcgtctgaattgttctgtcacaaaaccagcaagggagacaaatggtgcgtgtgacagggagttgggagtggaaggagcaaacctgaagggtgagtagagcagagaagagagagaaagtgatgctcctataagacagagatagggaacccaaaacagaagagtcaggtaacggaaggaggaaatgtagagagatggaatggggagtgagcaagtaagagagatactgggagaaagctggcagctgtcatgaagctctcctaaggggacttggggggaaatagagctctggttaaaggggaggatttcctctgtggctgaaaataaaaatcatcatgtagttttttgggggcttaatggaggtgagtcatctgtgacccaaggatgcgacttagtgttgctcaagtggagactggaggatccacgttcaaagatggcttgctctcatggctggcaagctgcagctggttattagctggaaacttagctgaggctgggagcctctgatgctctccacgggtttctccacgggctgcttgagcttcctcaaagcataatgggtgggttcccagatcaagtgtcctgaaggagcaaggtgggatttcatggcatttttgtgtcctagtctccacagacagaaatcctcacttgtgtggtcctctctcacactcagcagcttcatacactgcctgagtccaagagaaggacatataggctgcactccttgataggagcagggccccaggtcacatggaaagaagagcttgtgggaaagaaggtggtactgtgaccatcttcagaaaatgcaatttgccacaaccagttaaatggttaaaaaggaataacagtgtaacataaaaaatttttttaattttagctttaaaatttttatgtatacatagtaggtgtatatatttatggggtacatgagatttgtttgtttctgtttgagacagagtctggctctgatttcccagtgtcactgccactgtgggttcatgactcacagaagccttgatttcccagactcacatgatcctcctgtctcagcctcctgagtcactgggactaccaggacatgccgtcatgcctagctaatcttcttatttttggtagaaacaggatctctctgtggtactaagtctggtcttgagctcctgggcttaagtgatcctcccatctcagccccgcaaagtgctgggactacaagggtgagccactgcacacagcccactgtaacactttaaacatatttgaaaaggtagaactaatgtacatgtattgaaactacaacatgatactggaaaatataccttctcaggtttacaaagaacatttacagaaattgatcatatgtgaggtcacgaagaaaacattagtaagctccacatatagagatatcacaaactactgctgtggtcgtagtacaatacaactaaaagctgtaaataagctcacgtgccccagaactcataaaaatcaactgttaaagaactactgggtgccggcctagatatgaggaggaattatctactttctgataaattataataaaccctatagatttgaatctatgacatatatttaaagaggtgatcagagaaaagtagaccgctttgaatactcataaccatgacaatgggagtataaaaatgaatcagtgacatttctagctcaagggctagacataaaacaaagttaaaagaaagcacgaacaagtaataatgttaatatataaagcagacattaatgagggagaaacagaaataggagacacaaatattgaagagtgtctttttaaatcaatgaggcagatgaagcagtagctaactgaatcaaagaagcagagatagtgtttctgtatatatataataggtacacagacaggtagataggtaggcaggtagatagatagctagatagatagacaggcatagagatagatagatagatagatagatagatagatagatagatagatagatagatagattagatagatagatagatagatgatagatagatgtttgcacaggagacacacaactaccagcatactttgtttgattgtgctttattgcactttgcagatgcagcttgttttggaaggttcctaatgaccctgatttgaataatccgtgggcaccatttttcacagcatgtgctcacctcgtgtctctgtgtcacattttggtaattcttacaacatctcaaattttcagtaggactatatctgttttggtgatccgtgatcagtgctctttgattttgctattgtaatcacattgggaagccacaaaatgcaccctagaagaagcaagcttaatcaatcaatgttgtgtgtgttttgactgctccactgactggcctctccccatctctctcactctgctctggtctctctactccctgtgacacgacagaattgaaattaggccaaataataaccctacgatggcctctaaaggttcaagtgaaaggaggaattgcagatctctcactttaaatcaaaagggagaaattattaagctcagtgaggagggcacgttgcaagctgagataggccccaaactagaccacctgtgccaaagtcttagccaggtggtgaaagaaatgaaaagtgccactccggcgaacacatgaatgataaggaagcgaaacagatttcgtgctgatatgcagagagttttagtggacatatcatcaaaccagccaccagatgcccttaagccaaggcctaatccagagcacagccctatctttcctcacttctctgaggccgagagagatgaggaagctgcagaaaaaagacaaaaaacaaaaaacaaaacaaaacaagacaaaaaacaaaaacaaaaaaaaggagaagctagcagatactggttcatggagtgtaaggagagaggccatctccatcacataaaagtgcaagatggatcatcaagtgctgatggaggcactgcaggaagttctccagaagatctagctgagatcatgggtgaaggtggctgtgctcacgacaggttttccttctagatgaaacggccttctactggaagaagataccatctaggacttttgtaggtagagaggagaagtcaatgcctggcttcaaactttcaaaggacaggctgactctcttgttagggggctaatgcagctggtgactgtaagttgaagccgatgctaatttatcgctttgaaaatcctagggcctttaagaatgatgctaaagctactctgcctgtgctctagaaatgaaacaacaaagcctggacgacagcacatctgtttacatcgtgacttactgaagattttaagcccactcttgagacctactgctcagaaataaaaagattcccttccaaatattaccactcattcacagtgtgtctggtcactcaagagctgtcatgaagatgtacaaggaggttttttttttttatttttatgcctgctagcatgcatgaaacattcactctgcagcccatggatcaagaaatgattttaactttcaagtcttcctgtttagcaaacagattccataaggctgtagctgctatagatagtgattcctctgaaggatctgaaaaaaggaaattgaaaaccttctggaaatgattcccctttctgcatgccactaagaacattcgtgattcatgggaggaagtcaaaatatcaacattaaaggatgaagttgattccaaccctcacaaatcactttgaggggttcacaatgtcagtgggggaagtacctgcagatgtgatggaaatagcaagagaaccagaaagagtagtggagcctgaagaagaaactgaatcactgcaatctcatgatcaaactggaagggacaaggagttgcttcttacggaagaacaaagaaagtgatttcttgaaatggaatggaatccattcctggagaagatgctgtgaacgtagtagtagttgaaatgacagtacgggatttagagtattgcataaacttagttgatacagcagtggcagggtttaagagggttcgttacaactttgaaggatattcaactatgggtgagtaaaatgctataaacagcatcgtatgctatggagacaggtttcatgaaaagaagagtcaatctatgtgtcaaacttcattgatgtctaattttaagaaattgccacagccaccccaactttcaccaaccaccccaccgatcactcagcagccatgaacattgaggcaacacttcacaccagctaagagtgtatgactcactgacggctcaggtgatattgagcatttgttataataaactctttttaagttaaggcatgtatatatttttgccatagtgctattgcacatctaatagactataatatactgtaaacttaacttttacatgcaagaaacaccaaaaaattcatgtcacttgctttattgtgatggtctggaactaaacccacaatatctttgaggtatgcctgtaaataacaataaagaggaaatttttaaaaatcagaggggcctctttacacatctctatgccgataaccttgtaaaactatatgaactatgtaatttcttgtgaaaatacactcactatataattgaccccaatagcgcccaaaaggataaaagaacatttgtacagaggaaatagccttacgaaggaaatctcccatatgagaccaccaggcacagactgtttcataggcactttctccaaaccaaagcctactcttgagagctactgctcagatcaaaaggctccacgcccaccaaaacataaccaggtaggggatacaattacaaataaaacaatcatttacaaaagcaacaaaaatgatgaaaatatttaggcataaaattaagacatattgaaagcactatacggtgccttttaaaaagacacaaaagcagacttgggcaagtgggtagaaatcgtttgttcagtgttaggacattacggcatcatcaagatgttggttctccctaagtgagtttataagtttaatacaattccataaaaataccaacaccattccctttttcctggagagaagaagatggtatcataatgcccatttcaaaaggcaagaatagctacaaagtcacgggaaaggaagagctatatgggaaaactggccccaaacacattacagtatacacccagcctccataattaaaacactgtggtattcactggcatgggaatagagagacagaccaaggcaacattctagaaagtgataagacgacccagtaatatttgcaaattgggagtatgataaaggtagcatttcaaatcagcaggaacaaagagggactttgcagtaaataagctgataatggggaaagtgtatgctcttcaactaatgaggacaagaaaaccgaatttctgcacgggaaggaaaaaaaggaattggttctccacctgacatcaggcacaaaaatcaattgtaggtaagtcaggaaaaataactaatgggtactaagcttaataagtgggtgatgaaataatctgtacaacaaagccccatgacacaagtttaccctataacaaacctgcacatatacctctgaacttaaaggttaaaaagaacatgaaaaattaaatctcacaatctttattagaaaatagaggggaaatttttatgacttcagagaaaagataaatttattacaaaaggcacaggtaaacacagttataaagcttagcctcacaatatataagaactggaagaaaaacatcttattaaagtgaaaaatggttaattcaccaacatggatattgtactgtaaaaggatatgcaaacagccgagaaaaagaacccagtcttattagtaactggagaaatgcaagatcccaaatccatgccatttcacacccactagaatgacagcattaagcaaaaggcctattccaccagcgagtctgtgtaacagtgggaacacactcttctggtgggggatgcctcttggaaacaattgagcactggggaatattccctgagtctatgatccaggaattccactctctgataccgtgtaaacctttggcacgtatgccagacatctcactcttcatagcatccttgcttagaagggactgacactggaaagaactgacatgtccatagacagagaactaagcggattttttgtagattagccccacagaggtaggtgatggaataggggaaatgaaagcagcatgtctacaggtaaccacaacatttaatcaaagtcagagcggccctctttcacaacagccctagccacaacaatagagcagccctctttcacaacagccctgcccagaggtgaatggacaggaaatggacgcatgcggggtggagtggccccacacgggtacctgatgcaacaggggagatgagggcaggacggcacctgccaccccataggcaccctaagtgactcaacggtgagctaaggaggaaggggcagaatcccacagagataaggaagcaggtcttgtgatgtggtgggtgcacgggacgcacagcaggaatgcctgggatgcagctgggcgtgttggaagcacacagggcatgggagggagcctgggccccacttccagggtgatggccatttctcccaaaggagaagggtggctggaaggagtccaggtacaaggtcctaggccacagccacatggcctccacctctcagggcagggtcagtagctgctccccactccactcccaggtccttctgtccttccccaggatgaggagctggaggaccgtaggggtggaagtccagtccacagcagccatgggccatccctcaggggaaggcgtgcccagtggggggggggggcgtggctccacatagccccacctcccacatgcactgagccagccaatcaggaaagggcacccacagtcaggccagctgctctcgcgaggaccaaggacccaggccctcagaggagcatcaaggtgccaggtcctggaggtcctgtgaggaggagaggtcgagggtacctcaggagaggacctggccggaggggagactgggaccgtgtagtccgaggtcctcagaggacgagagtgtggatcttggggcagctcaggctgacctgtgaggaaatctccccagcgtcacctggggcctgggtcagggagagtcccctaggggcaggctggcatgggccagggaagggagatcgaggggtccaggtggtccccagtgcccgggagcatcactgggttctgtgcatgtgctggaggctgggggagagtccgcgtgtgtccctcttgctcggccacccatctggatgggacccttggtcaccgggggtctgctgggcgtccaggcaggtgagagggcagatgccagcacctgactgtcgaggacgggtacacagaggttcattcccatgcagatggctggggaggtcctgtgtcaccctacagctctcccgaccaacacggggtcacttggggacccggggcaggggcaatctctgtcccaagggcacggcaagaattcagcagaggacctggagttcaggtgtgcggagcaggtgtgagctctgcaggcagccccagggaagggctggatgggacataacgggacaggtggggacgctggcctcttctcccttgtcctttgctccttcagcagtagacacggagcatgccagccccactcttcttcaacctggggacctccccgttggctctcatttaacacacctgggttccttagtgtgtctttgcactcacaaggttcaggagtcgtctctagcctcccaggacggccagccatggtgcgtatggacgggaagtgcgtcagggaggctgacaaggccctgctgtaaactcagtttatggtagcccaggaaacggggcatggacgtaaaactggaatgaagggtcaaggaaacaggtgcccgcccaaggggacggtctgtcttatctccttgcaccgggtcgtggggagcacatgggcagcccgtggcaccctcgttactttggtgcccaccttgcatatgctaagaagccctaggtttctaaagcagtttcaagggctttaggtttcccatgggaagctcctgccccacggcagagttacagatgcccttagagctgctcttctggatgtgtgcagtccgtgacgtccaaggagtctgatccgcagtgcatggttatctatgacttcagtcctggagggcttgcaaaaatgtctctgtaaaatggtcagggctcaagggactccatgtatataggtctgctttaaagctttaattggcaaacagccatacaaacccacaaatagtacatttccatgtgaaaaaatgtccacaatagcatccttcctctaaaaacgtttgccttttcaaattttcagtgcagcacggaattcaggaatgcacagccatcccgaaagtagtcattttgcagaaacagatgaggaagacatgtggtaatgtgtttaatgtaattgtgcctcctagtaaagtaagttcagaaaaatcaactttgactcgtggcacattttgtgtttaaaacactgggcatcaggcatgccctacaacacaagcgtggtatcttattcacacctagtgaaaaaaaaaaaagtaatttcttccaggaatgaatttcaaaatatgtgggaaagctttgtaggtgtctgggagatacttgtaattcaagaacattgttgtcagccatatatcttttatagcaagaaatgctaatgagggggctgcattagtgttatttaatgctttgttctcctatccaggatgccacataaggattgagtgtgattcagctccatcgatttccttccttacccttttaagctgttgagtgaagtggatggtacacacagtggttaggcagagtaatgcttttactttattcactgtggaatatgagaaaataatttacaaataatatatattccacattgtgtcagatagtaagtgatatatctgtttttcatatccattgctgttttcttattctagttattttataagactttcccatttctttcttggggtgggcagtgcaaactgaggcctctaaaatagcctcttattgttatgtttacattaataacctctgtagtggagaactcagacaactttgctggcatgtgagagacgtgtgatcacaaccaaaaacatctaagttttaaatggatacctcagctatcaagcatctaagttttaaatggatacctcagctatcagttaaattaactatgtaaaaggacaaactcttaaccgtgtcattctcaagttttatctcctctatttggatcatatatgtgagcagatacatgttgaaagctttgttgtattttgtggtgaaaatgtgcttgatgtgcgagctgtcttattaattggttgttatagacggtaaactgcatttataaaatatttttatagtaatacagctccctcctgaacactggaaaataaccactgacggtaggtccataacatagaatcaatcatatggttagcaaggaattgtttgaaatacttaaaaaatgtacagtgttacagattgtaaattttacaattttgcaaacttacaatctgcagcaatttggggagaaatgatatatgaaaacctgcatgaaagtatccaggaagtgttcttgaataaatattaatttccttaaactatctgtggtcatttttcttagtcaaattgatttaaaagcttcccgggctaaattttaaaaatactattcttagtttatcatttatttatttttattcctttgaaaatggaataattgtagttggttaatataatgtgttctaaccatggtcggtctaaacatatccttgagttagagtacattttattaatttattaagaattatttttcagaaaagttttctcataaaaaattataggctctccttgagaccctttttacaagttttagaaaacagacagcttttctctttaactccttattacatcttcgaaacaatgttttccatattgaggtatctgtcactgtaagttttcacagacgaaaatgaggcaaataatcttttgttttgaaatgatgccaatttgttcatgctaggtgtctttttaatactgctgaaccaacattacctttatggacgtgaatatgtgggagcaaaataattttaaacaaaattttaatgagtgttttccatatagggcactttaaaaatgttcctaaagcatcgataaaacatttcaaaatgaatatcaatgcttccacgaaaatcattcagcaggaaattgaacttgcttggcatacccgggaagaacaatggtaagattgttggttatgttggagccagatgctttgtttcatttcttagcattcgtggatacaaactactttggaaaaatgctatgatcgtccatgtgctggaagtccaatgaaaaaatatatttagctggatttttctctaaagaaataattccttaattaagaattaattaatacttaatttaaataatctaagtgctatgatgccacatcataatgaaatgagatgtgtatcctcgagttcactaaacatgacctgttttctctttcaaattacagtcgattttgcttatcatgaaaatttgtattcattccatgaatgtgcttgctgaattaaagttaaaagtcttaaacatttagtcttgtaatagttatttgtattcaattacacagacaaagattaatgttatattgtaaataatttgtaagcttcactgaactgggttcagtatatttttttttgtacagaattcttattgtcagaaagtgaggaaaatgaaatattcctgtttggaaatcatagatgataaaggagtgtaatatccaaattaagtctatttgtgatatctcaacttatatactactcaaaaagagaaaataaaaactaaaacacttgcagagaaaaatgcattttttttctggaaaatttataatacaataaatcttccttaatttatattagctaaggcatgttaagatagcttccgtcttacatttactagccttcttttttcacccatgccttgactgtaccatggtcacacatttcttatccaaaagcaaagggattgttcatataaagaaattatgagtgttggttgatcagctcagttttggaaatgttaaagttgaggtgcatatgaagcacctgagggcggatgtcaagtggggataagcaatataccctggatatatgagcctcatgttcaggagagtggtaggagctgaggacaccagagcgggaattaatatcacacagattgcgtttaatcaaggagactaggagagatcacctagggaatgactgtaaacaaaaaagggaagtctaaagactgattccgcgttccttcaatactttgagctaccgcagaattggggcatcagtaatgaagccgaagaatgagtgaacaaataagtaaaagaaaaccagctgaaacacagtaaagaagaccttttagaaggagagaggaccacctcatcacatgctgctgataggctgaaggagggggacttggtatatggaggccctttgatatccttagtaagagtggtttggtggaatggtgggtgcaaaggactgattggaaaagacaagagacaactgggaagaaagaactggggtagtaacctgaggcaaaaaggagtagctagaggtttttgtggttttcttagtgattacagaaggaccggcatgttgtatgctgataggaacaatatagagggaaaccttggaaatgttggaaagaggaggggaaagtgctgaacgatgttcttgagaagcagtgggctctagtggacaggggagcaagttgacttcaggaaggagtagtagttcatgcatttaaacaggagagaaggtcgagtgcgtaagcactgatggacaaaggtgggtgaagatgtgatgctcggacgctgaatgtgccctgtgggttgcttctgtctctgtagtgagataaaagatcatcagtgacaagtagagatggggcaggagggcagagaagaaggactatactttttttcctgagactgggccagtgagtggactaggggaatataattgtcaagcagcattgggagtgcaaattagattagtgtcatcataaacacgactttgagatctgttggcatggttgtgttagggcagctggagagttggatttttctgggttggcatttggctgagcactgtgacagagggagaagctggcagggcacatacacaaggatggagttatggtgagtgaccatggaacttaatctgggaacgaagaaagggagtgttgggcactccagtgttggacagtgaaaggtgctctattcaatgggcttcagttcctgatagactcctgagctgtagtgcttagagtgacctacagtgtgagggcattagttgttgcatgttggatacatggggaaatagcatagtgtagtggtcaaaagcccggactcaacccccactgtttagaatctaagtctggttcgaccattgctgcctgggaaaccatgagcaaattctttctgtgtcccagcttgctccattaatattgtgggcataatgtgagtacctacctcacagagttgttttgagtgttaaatgaatttttctataataaggtatttaaaatggttcagaacaggatctgacatatggttcctatagtacaactttgcttttattaatgttatgtagatattgtagattctcaggaatgtcaaaatctaggatgtggctatgtgagtgtttaatttgcaggaaatgtcaagatcattggtggtggaacagaaagaccagttttattggaaggattacgtgtgtgggctttgaaagcatcaaggactaaaacatatttgtagaatattattaaaaaggaacatttccataaaaaatgcatgataggattattatatagtttttgtatattattgttggacacaaatttcataaacttggtcatagtatttgttaataagaaaaaatattttcaaatgataatttcaaaattgttagctttaacaaagaattgtttttttgataaattttaaattttactcgaattgttatcgagttttctttgtatatttgtagagcatatttctcaacagcaacaaaagactttttcaagaatctgaaattgttgagggccagagaacaaaagcatttaatgcattatgtgaggaattcttacaggtcagtggtatttggttacacaacatattctcgtaagactttacatgtatattgaaaatttaaaaaactgttttcctttccaaaatagtgttaaaaatactttgattataaaattcttaagcattttccatgttaatgtcattgttttaaagtaagaactaaatgtatttttacttttagaattcattaattgtttttggtgtaatccaaaacaggaaacggtaacttggcaatttcacccagaaatatacataccgtgttggctattcacactttatttacatgactaaacaccatgactcttttgctcgacagtttttactggtgcagcaatagatgaaagcaagaagtttctacatcatttctagatgtggtttaatagtctttctagtgccagtgtttctcaaagagaaggcacccaattgtaacaaatgggtattttttatttcaaatttatttcctgattatttcatgacatatttgcttgcactattattgaagtgactacaaattgatttctctgccaagttactatcacaagacagggcccagatgcgttcagaatgaaaaagccaggaaagaattaacagtttgtgactgagaattgtctcccgtcacatttgtacttttgcaagttgtcctcagtgatattgacctcttaaccatgcaggtatatatctatttaggtttctatggaatggtgtacattcctattcattttataaatttggagtgtttttaaaacaatcttgttcaaattcttgttaaaaattcactcttctaaactgaggggattgtttcaggaaaacgagtttcaggatagtcattctttacattgtttactatgatacatatactacatgtgtgtatacatatatgtaatatgtacactcagttgttattcaagtgtttctaagtagaggatgtgttgtttaatggtctctgagaaccatgtaccaattgttacacatgtttgggaaataagatcttctcaatgttagtgctaaatgtcaccacttatggtgggaacttcatgatgatttagtcttctgcatttccttttccttcccatccagctatctatcactaggccctgccatttttaccacctcaacgttattttaagttttttgtttagattctcactgctgctgtcctagctcaggacctcatccttcctcacttacgctattaaaatttcatctgagttctctcttcctctttccatccttcatagatctgcaatcttatcttcctaagacatcgcccttccctcttcccaacctgtcacgagctttccattctaaattcatggatattcagagacacctctgccttgacatgacctccttttaaaacttcatttgcttttgtccttgcgatagtttgctgagaatgatggtttccagcttcaaaaaaccaaacactgcatgttctcactcataggtgggaattgaacaatgagaacacatggacacaggaaggggaacatcacacaccggggcctgttgtggggtggggggaggggggagggatagcattaggagatatacctaatgttaaatgaagagttaatgggtgcagcacaccaacatggcacatgtatacatacgtaacaaacctgcaggttgtgcacatgtaccctaaaaacttaaagtatattaaaaaaaaaaccacttcatttgctacattctttccttcctgtcatccctccaggttgatagccttctgtgaaataattcaccattatttccaggctttatttaagcccttccaccataaaaattttatctccttttgctaacctatcgaaatctaattcttttgccaactaagtaggcattgatctccattgtccactgtacagtgccagcaagttgcccttccatgtctattgtaacatttttgtatgacttcagtttacatgtttcctgaagtcactggaatatggaaaagatcatgtgttcatcttctaatgccaccatagcacatgacatcctaacttttctgtagcaggcattatttcactgtttgttgaatgaagaataaagatttaaaattcaaattgtatttttcgtaactcgagatcatactactgagcattttattccctctatctatggaaaccatgttacatgcaatatcagggataataaatggtcgaatacctggtgtttgggaagcttatgaatgaaattagcgcatggatttacatggaacttccattctttttgctatatcttcacctgaacatttcaatatcccattgtttggagcaaattgtgatattgtcgtgcctcctactgtaatcataattgactaaattcacacatttctatgtttcttaagtgagtattttggtcttcgggtagctcttagagtgctttttaaatctggaatagataataaccatcattggaattttaaagtgttttgcttttgaaatgtagttatacacagttataaggtgatgaagagtggttggttataactgaacttggttttttgttgtagcacgtggaggacctggaggagaatcatacagtttgtcttactggtgaacaaagtgaacttagaaaagaaatggggccgggcgtggtggctcacgcctgtaatctcagtgggcagatcacctgaggtcaggagttcaagaccagcctggccaacatggcgaaaccctgtctctactaaaaatacaaaaaaaattagcgggacgtggtggcgggcacctgtaatcccagctactagggaggctgaggcaggagaattgtttgaacctgggaggcagatgttgcagtgagctgagattgcgccattgcactccagcctgggcgacaagagcgaaactctgtctcaaaaaaacaaaatggaaaaaaaaaagaaatagcagtgttgtaaacagaatttatgaaggaaattggtaaaattgaagattgatttaagcagtaaaatattttgttcgctgaatttttctaatatttacctaaatattcaataaatgattaatatcacttttcatgtaacagcatctgcaagaggtgtctggtgttctcctatcgcagttattctgatgacacttcaaagaacaaagctaaacctaggtgatagcatacagccataaaattagctccatgaaaccgatgtggcctgaaattcctagtttaaattgttgcatactgtttgttttcatggtggatcccttttctgctaaaacccatgtaaatcctaaacagttatgtgagcagtagtagccaatccaaagttgtatgtagcgggctttcagtcctttccctaataatggtcacctagtctcccaaacattgtcaatgaacttttagcaataaagatgatctgattttacatttggcctcagtggatctatatcagtctcaaatggtagaaatcacaagtatttaagcttacattgttattcctaaggagaaaaaacataagacaaaatctattttatgaacttatttttgtgtatccttactaaattatgaaaccaattttcatgaaataaaatttgagaggaaatatgaaaacttaaaagcaacataagtttgtaccccagaataaattaaactgctaaaaaccattaagaccattgaacaagacatgtaagtatacattgtgagtcatggattcatgaatatggcattttcacaaacacatcaaaatgtcatttaattgatttggtccactattaaatgatgcttgtctttagcactgactagaagtgtttcctaaatatacaagtatgcataattatttatggtttacatgtttcaaggctttctgtagagataaattatctacagaatttttttcaagtgcaatattcagttagtatatgcaaagtcatttgtatatttatttgaatatgagaacaattaatgcctatatgttattttaatgcacttaaaaaatataataacacttgaaatcttcctttggaaacatttgatctaacaaatgaaattgtttcaaatttggttagaataagtcagttaaatgtattcttttgctgcattacagaaattggcttcatgccattcaaaatcatcaatatttccttttgaaggagaggggaactttcttctgtatttgtgcagctttggagagggagatgtacgaaacggaattagctgtcttgtagtgattggagctgtgtgatgaaaatgtagtgatcgctatagtagtctttccagtttggtgcatgtttgacaagtttcaagatccccccactgtgtagaattgtcagaaactactccagccacatcgacggacctgagaacattatgcttaagttaaacaagcaatttccagaaggacaaatgcttcagattccacttttatgagatatctacaatagtgaaactcacagaagcagaaagtagcatggtgattgccaggggctaggaggaggggaaaacggggaattggattgcaatcggcatagagttgtagtcatagaagatgagaaagttctaaggatccactgtcaaacaatgggcatatacttcattatactgtgttatatgcctaaacatttgttaagagtatatatgtcacgcactgtgtttttaccacaatttaaataatactcctaattcccttatttcatctattcaacaccttaaatttaaataatactgctaattcccttattccatctattcaacaccttagaaaaactgttagtggccaagcgtggtggctcacacctgtaatcccagcagtttgggaggctgaggcgggtggatcacctgaggtggggagttcgagaccagtctggccaagatggagaaaccccatctctactaaaaatacaaaattagccaggcctggtggtgcacgcctgtaatcccagctacttgggagtctgaggcaggggaaccgcttgaacccaggaggcagaggtttcggtgagccgagatcctgccattgcactccagcctgggcaacaagagtgaaactctgttgaaagaaagaaaaaagaaaggaaggaaggaaggaaggaaggaaaggagggagggaggaaagaaagaaagaaagaaaaaagaaagaaagaaagagaaagaaaaagaaaggaaagaaacgaaagaaaggaaagtaagaaaataaaggaaagaaagaaaagaaaggaaaaagaaaagaaaacctgttagtacttcactggccttgtctggccgcatggtgtatgagggaatgtgtgggctctggagtcagacaagctcggtacaactgctgggttatctcgaacaggttattaaccttgctggtcctcagtgtcatcttttctaaaataaggatgaaataagatgggcccatctatcttccagcaccattgtatggattcgtcctgtgagttgctcagtcatgacagtcattattatttattattattattattattttgagacagtctcgctttgtcgcccaggctggagtgcagtggcgcgatctcggctcactacaaactccgcctcccaggttcacgccattctcctgcctcagcctcccgagtagctgggattactggcgtgtgccaccacacctggctaatttttttgtatttttagtagagatggggtttcatcgtattagccaggatggtcttgatctcctgaccttgtgatccgcccgcctcgacctcccaaagtgctggggttacaggcatgagccaccacgcccggcctattattttttgattagcatctggcctttcaccgggatcatagtagttatccagtaattatttgttgaagtaataatttaattcaaccttaatgaatttttttattttacccagaattcacacacttctccattttttactgcaacaattcttaagtaattatgggttgtattcaaagttctcagtctagataagattgaaaattatgtatcagcttactagtcgagctctttttgttattacgcttcctgaagggtcttcaactctgtttctattctgactgtgtgtactctttcccactttcctggacctgtgcctaggacccttctccaacagccctacaagtagttaatccccagcacaacacttttctgccaacagtagtcttctatttctttcaggaaaacattggctaaaagctcacattttccataaaaatatccctgtatgaattgaccctacatcgatcttgctctcactgagggtttcttctgagctcatacaaacctaaagcaggtcatttcacacttggctattgggtctatagcagagtcacagaaatatgactcctgtccctaatataaggtaagatgtggtccctaaagcaggggacttttcttgagtgtcttttctcccttgcacagtatctaatacagtgctgctcacagcactgagcagcagtctttaagacggtggtttggaatttgatctttgcagacttgagttttcatcctggccttgtaaactacaggcactgtaagaaagtgtcccaaacgctctgccacatttgtacaggggagatactatgcattttatagggcgtgatggttaattttaggtaaccaaaatgtgactgcgttcaggaatacatagagaactggtaaagcagtatttcagggtgagcttctgtaggcattccagataagattggggtgagttggtgggcagagtgaggaagttaccttcaatctgggcgggccacatccaattcgttcaggaccttgatagaagaaagaaggcaaggcagatgaaatgcactttgctccctttctctgctgaagctgagattcttctctttcttttcagatggagtcttgctctgtcacccaggctggagtgcagtgggaccatttcggctcactgcaatctctgcctcctgggttcaagccattctcctgtctcagcctcccgaagagctgggactacaggcgcatgccaccaagccagctaacttttgtatttttagtagagatggggtttcaccatattggccaggctggtctcaaactcctgacctcgtgatccgcctgccttggcctcccaaagtgctgggattacaggcgtgagccactgcgcctggccgctgggactcttattatctggccattggacaccagaactcttggctctttggccttcagactccgggacttacacgcccattccctggcctgcccaggttctcaggcctttggccttatattgagagttatagcattggcttctctggtactgaggcttttggatgtggactgagtcacattcctggcctcccagggtctccagcttgcagacagcctgaccttagacgtttcaccctccaactccccgaatcaatcccctctgatctgtctatgtatctttgtctatatcctgttgatggtgtctcttaagagtcctgactattccacaggggtaatgtgggggagaaatgaggtcatgcatgcagagcatttcacaccctgcctgacacatgcccttgcccagtagactgcagctacagttattctagagcttacaatcagtgttcaaaacagtggaaggccttctatctggtacctagccatcacattgagcttctcctgtcatttatcaatttcagacttgttttgagagcaagtccctgttctatgcagcactgatgtggggctaaaacatttttaggcatgagatactcaagctgggaatgaacaaaggccagaatgttcttcagagttgggagcagaggaagctacatggtcaagagacatggacatgagccttcctgcaatatgttttatttccaggggtctaatgagaaagacatgcacatatgtatatatcatctcatgcttagctccttaatatgcccaaggtgttttcatattttttcagcaattgtctaccacagctgagagtcacatgattacctgttgttggtggctgttggcaagggggttttttctttagggacacaggaagatttgcctaaaaaggtcagaaagctttgacatccattattttattataaaggtcctctacagctttggtggtataatatttcgggcctttacttttctcattccactctttattttaagcctgagcttgtgggtccttggagaaggagagaaaatatttaaactctgatcaactaatttaactatgtatataacatgtagaataaataaagacttaaatgaaagcatagcatttacgaaagctccaacaaattaaaaggtaatttaaacgattgatttctggttttagtgacttgttgttaacaaattaaagcagtttgtgaaaataaactcagttacattttttgcttgtataagttcaaaatcgtaattcctttccaaagctgaacatgcctgaaatgggtctgccaatcatcacaataaaacaggaagcccgaatgcaagagctagttaagatgggttcccaagcaaatagtagttgaagctccaacggccgtaaaatgatgaaagaaacatggtttaagagccatggataatttttttgaatgccaaaagagttatcatagactgatttgacatagagattttaatggaaatgtcatggcatcaaaataaggtgccagtaagcaaatcagttcttgaatgtaattttgaaacacactgtgcaaaattgctcagtgcaatgatgtacactgatccaaaaagtgaccactgacaagacatggtttatttcggtttttaatctattatggaaaaaacgaatttctctttggaaagagctatacgaccatgtccaacgtgatttcctaaaaagacagcaggatgttttccttctgaccagcttcccacccataaatgcaaatattattgttcagggttgatggagcatttgcaaatcaagaggctttgatttacatccagcatgctcattcttcgatggtagatccatataagaactacaaaagacatagaagatactagaatacattgttggagttcaggatgtgggacaatgccctgtgtctgttgtacagtgtcccagatttttcaggatttcataggaggcagctacaacgtacacatgcaaagccctgaaatgccttccttagctaatgaagtggagccctgacgtcacctaggaaagggatgcaacagaactcatttatagtttctcaaatgatgctcccatttcttcaaagccaccattaatcttaacacctttaaagctataataacaatctatgtaacaagtggaaaatgcttatagaatcagtgctttccatcacaaacccttattgtatggaaattcacatttccataatcacataaaggtaaaaaatgttattcattatgaagctaaaaggtatgaatttctctgtcataatacttactgaaaactggaaactgaattgtgaaaattttgtactttattcttcttaaaatgatagtttcctttctctgtttgcctgtgaagcacgcttcaacaataacaccttaccttccaatacaaatgatggtacacaaaacacacacaggcacacacacacacacacacacacacacacatatatatatacacacatatatacatatatatgcatagtagaaaagacctatgtgtttctaatgtatggaaatgggaaatgtacatccagtcttctcagttgcaaaaataaagcagtttttaagtagatagttttggctttactttgaatagatttgtatcaactttgaatttttttcttaattatattagattgtagggaggggactctgtaaggaaggatgatgcaaaggattcttccaccagtttatatgaaccaaaaggttttgtgacagtgaaacataagtagtgtattagagttctctagagggacagaactagtaagataaatgtgtgtgtgtgtgtgtgtgtgtgtgtgtatacatttcatatatctatagatttcatagatatatgtatatatatgaatgtatagatattttatatatatatatatatatatgagaaagggaatttattaaggataattgactcacaggatgacaacataaagtcccaccataagctgtctgcaagttgaggagcaaggaagccagtagtggatcagtccaagtcccaaaacctcaaaacctcaaaagtagggaagccaacagtgcagccttcagtctgtggtggaaggcccgagagccccaggaaaaccactagcataagaccaagagtccaaaagccaaagcagttggagtctaatgttggagagcaggaagcatccagcatggggaaagatgaaggccagaagacgcagcaagtctgctcattccaccttcttctgcctgcttttgtctagctgtgttggcaggcaaggggatggtgcccacccagattaagggttggtctgcctctcacagtccactggctcaaatgttaatctcctctagcaacaccctcgcagacacatctagaaaccacactttgcatccttcaatccaatcaagttgacacttaatattatccatcacaagtaggtagaatccagttcttggtacttgatttaagcaccatcaagatcccataaaggcggaaaccttacaagaagccaagtcatcctgttaaggggaaatttgtctccagtgctcaatcctgacctaatcctcatcctccatgtctggttaactgaggacttgtccatctgaccccaaccccgcaacacccaccttcctcccttcccacacaccacgtcttccctccttcctctcttcccaccatccgagaaggagcagacccacacatcattttacaacaagttcattttattttcatcaccatggggcataccctgtgggatctaaaatgtactctagaccccattgactatttatctggggccagatctctggagacttctcaaatagatctgaggtctctggccttgccctgaaattaatggctgcccagggagaagcttcaggtggtggaggtctcctggctcttttggtgttgctgtggctcattttgattgagtttctcattcagctggtcacagtgtctggattgcattggccctctctcatgctcagcttttcttgaagtggtgatcattctggagaagctttttccctggaactccctcgaagtcttccttttccctttcagattgtcttgggacccagaaggacagcagagagatcacagaaaggcactggttttggggaaggggatagaggatgagtgggaccaggggtttcatgtgaaggttacaggctgggttgggcggttgtgccaggcaaggacagggtaggagtcttgggagggaggagtcaaggggaagacaaggaggagcttgggtgtgtcactcaccttgatagggcttctgggcctgggttaagagggggcctttgtcttccttgactctttggtgttggtgggtgggggttctacaactggtctgattgcttggtttcctggttatcttcaccacctcggggtctctcagtggtctactccaggcctcctggcttccctatatatacccttccaggacagggcggggccacaccactgagctttgattggtcagcaaaccactacccagccaatagtggctctgctggggtgtgagggccttagatagcagaaaccatcatcagagcattgtcatggtgggaggagagaaggagagtggggagggtgatctgacgaggaagccagtatgctctggttgaagaatgggggacatttgtttggcatgcctaaagagccttcccaaactgattagtgctgctcctttcctccaatgttcagctttgggggggtcacatagcagaagagagtgtatttcctccaagcctttccccagagtcaccctatttcagtgcttccttctgttttctcccaccacccaccattatctagttttcccacaccttaccagaaagctctgcaaggtaatctggctgtaattaagtttatatggaggtgtgaatcatcctacttcccccctaaaaatttctcttatgcatcttgaagcccactcagtcggctactatccaggaatttttctaccctacttcctgttcccagtgtcctcagaagtctcctggtgttgcaggaagtcagggaccctgaacggagggaccagttgaagccatggcagaagaacgtggattgtgaagatttcatggacatttattagttccccaaattaatacttttataatttcttatgcctgtctttactgcagtctctgaacataaattgtgaagacttcatggacacttatcacttccccaatcaatacccctgtgatttcctatgcctgtctttactttaatctcttaatcccatcaccttcctaaactgaggaggatgtatgtcgcctcaggaccctgtgatgattgcgttaactgcacaaattgtttgtagagcaagtgtgtttgaacaatatgaaatctgggcaccttgagaaaagaacaggataacagcaatgttcagggaacaagagagataacctttaactcagaccgctggtgagccgggcggaacagagccatatttctcttctttcaaaagcaaatgggagaaatatcgctgaattctttttctcagcaaggaacatccctgagaaacagagtgcatccctgagggtaggcctctgaaatggccacttcggggagcagccatcttttatggtggaaactgtagggatgaaataagccccagtctcccatagtgctcccaggcttattaggatgaagaaattcccgcctaatcaattttggtcagaccagttgtctgctctcaaatcctgtctcctgataagatgttatcaaccataatgcatgcccaaaacttcattagcaattttaatttcgcccgggtcctgtggtcctgtggtcctgtgatctcaccctgcctccatttgccttgtgatattctattaccttgtgaagcacgtgatctctgtgacccacaccctattggtactccctccccttttgaaaatcactaataaaaacttgctggttttgcagcttgtggggcatcacggaacctgctgacatgtgatgtctcccccggacacccaactttaaaatttctctctttggactctgtcccttcatttctcagactggctgacacttagggaaaacagaaaacagaaaatttttgcctgatatctggctgaatttcgcccgacatctggctgaatttcccctgatatcctggggtttcagttttcccctgtctgaaatcactgctttcaagctgtcaaatttcagtgaatacatttgctccactggatatcacatgagtattccatcaactgtgaggtcatgaccctctcagtaggtgtagtacccatactcagtaggtgtagtaccggggcttggattttagcagtgtagggaggatgaggcagattttctcatgccagaaatcacgcaggatgtttacatgtaggaaactacaacctaacactgatgagttcatggagcagggtgggattgtgtaggatagttcatcactgtgcctgaggttctctccagtgtaacaaagttttttcaaaagaccttacaattggaaaggaacaaatacaaaaaaaacctcctcatttacataatataagagtatatgcagacaatcctatcaatgtaaaaatgcttctagaatgaatacaactttagcaatgttggtggatttaagaccattatacttgtattttaataatagcaataaacaattggcaattgagacaaacatagtacaatttaaattaacattagaaaatataaattgaaagggataaatatgacagaagatgtagaagatctgtccattgaaaactataaagcattacaaagataaattcaatgaggatatatgtaaatagagatacaaactttattcatgagtcagaaaactgaatattaagatgtcatttatttttcctcaacttttttgatagattcaatgcaatcaaaatccaaattccagattttttaaaatagaaattgggaggctagcactaacattgatatagaaatgtaaaggtcctagaatagccaaagaaaacattaaaaaataaacattagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaagcaacccacaaaatgggagaaaattttttcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacatatgaaaaaatgctcaccatcactggccatcagagaaatgcaaatcaaaaccacaatgagataccatttcacaccagttagaatggcaatcattaaaaagtcaggaaacaacaggtgctggagaggatgtggagaaataggaacacttttacactgttggtgggactgtaaactagttcaaccattgtggaagtcagtgtggctattcctcagggatctagaactagaaatatcatttgacccagccatcccattactgggtatatacccaaaggactataaatcatgctgctataaagacacatgcacatgtatgtttattgcggcattattcacaatagcaaagacttggaaccaacccaaatgtccaacagtggatagactggattaagaaaatgtggcacatatacaccatggaatactatgcagccataaaaaatgatgagttcatgtcctttgtagggacatggatgaaattggaaatcatcgttctcagtaaactatcgcaagaacaaaaaaccaaacaccgcatattctcactcataggtgggaattgaacaatgagaacacatggacacaggaaggggaacatcacactctggggactgttgtggggtgggggaagcggggagagatagcattgggagatatacctaatgctagatgacgagttagtgggtgcagcgcaccagcatggcacatgtatacatgtgtaactaacctgcacattgtgcacatgtaccctaaaacttaaagtataataataataaataaataaataaataaataaataaataaataaaaaatagaacaaatgtggtggggttaccctacttcatttcaaggcttataaactaacaatgatcagtgtagtcggaattatcattattataagaatatatcaatggaagggaataaagcccaatagtatatacacatgtatatgcatatatagacaactaattattaataaagatgcaaatgaaggtgagaggagagaaatggcagtgtattcaacaattgggtctggaacaattggatagctcatatggtttggctctgtgtccccacccaaatctcacctggaattataattcccataatctctgtatgtcaagggcaggacaagctgaaggtaattggatcatgagggcagtttccccagggctgttctcatgacagtgagtgagtttcacgagatctgatggttttataagcatctggcatttcccttgcttgcactcactccatcctgccaccctgtaaagctgccggcttctcctttgacttcctccatgattgtaagtttcctgaggcctccccagtaatgtgggaactatcagtcaattaaacctctttcctttataaattacccagtcttaggtatttcttcatacccaagtgtgagaatggactaatacactaaattggtactgaggtagtgtggggcattgttataagatacctgagaatgtggaaacgcctttggaactgggtaatgggcagatattggaacactttggagggctcagaagaagacaggaaaatatggaaaagtttgaatcttcttagagattgttgaatggctttgaccaaaatgttgatagtgatatggacaatgaagtccaggctgaggtggtctcagatggaaatgaggaacctgttgtgaattgaaataaaggtgactcttgctatgctttagcaaagagactggcaacattttgcccctgccctagagatctgtggaactttgaacttgagagagatgatttagggtttttggtggaagaaatttctaagcagcagagcattcgagaggcctggataactacgaaagcattcagttttatgcatccacagagacggtttgaaattggaacttttgtttaaaaggaaagtggagcttaaacgtttaggaaatttgcagcccaatgatgtgacagaatagaaaaatctcgttttctgagaagaaattcaagctggctgaagaaatttgtataagtaactaggagccaaatgttaatcaccaagacaatggggaaaatgtctcaagggtatgtcaggtcctcctgtcacaggcccagaggcctaggagcaaaaagtggtttcttgggccaggctgagggtcttgctgctttgtgcaatctcagtacttggtgccctgtgtcccagccatggctaaaagcggccaatgtacagctgaggccattgtttcatagggtgcaagccccaagccttggtggcttacatgtggtgctggtcctgccagtgcacagaagtcaagaattgagttttgggaacttctgcctagatttcagaggatgtatggaaatgtctggaagtccaagcagatgtttgctgcaggggtggagcccttagggagaacctctgctagggcagtacagaaggaaaacagagtccccactggggcattgcccaatggagctgtgagaagagggccactgtcctccagatcccagaatggtcgatccaccgacagcttttgctgtgtgcctggaaaagctgcagacactcaatgctagcacataaaggcaactgggagggggactgtaccctgcaaagcaaaaggagtggagctgccgaggccatgagagcccacctcttgtatcagtgtgacctggatgtgagacatggagtcaaaggagatcattttggaactttaaggtttaatgactgccctgttggatttcagacttgcatggggcctgtagcccctttgttttggcccagttctcccatttgggatgggtgtatttatgtaatgttggtacccccattgtatctaggaagtaactaatttgcttttgattttactggctcataggcagaagggacttgccttgtcttagatgagactttggatttggacttttgggttaatttgagaatgagttaatactttgtggggctgttggaaaggcaagattgtgttttgaaatgtgacaacgtgagatttggaagtgaacagtggcagaatgatacagtttggctgtgtgtccccacccaaatctcctcttgaattgcaatccccataatccacacaggtcaagggcaggaccaggtggaggtaattggatcacagggacagtttgctccatgttgttctcacgataatgggtgagtgtcacaagatctgatggttttatatgcatctgacatttcccctgcttgcactctctccatcctgctgccctgtgaagaaggtgcctgcttctcctttgccttctgccatgattgtaagtttcctgaggcctccccagcaatgtggaactgtgagtctattaagcctgttttcttttaaattacccagtcttggatatttcttcatagcagtgtgagaacagactaatacaatatctatatgcaaacccgaatttcaatgcatactctatctatttatctatctagctaaaaagggagagacagaaaacagaaagatatatacggaattatctcacgggattatgaggtctagtacattaaaaatctgtaaagtgcaccagcaggctagaaattcacacagcatttttatattacagtcttgtgttagaataccttttccaggaatacttgtttttttctcttgagacattcaactagttggatgaggcccaccaacattatggagggtaaactgctttacttaaattcaaccaattgcagatgttgatcatatctacaaaataccttcacagaaacatctagactagtgtttgaccacacaactgagtactatagcctagacaagttgacacataaagctaaccaccaaacatatcttgcaccatataaaaatgtaactcaaggagaacacatggacacagggaggggaacatcacacaccagagcctgttgcggggtggggggataggggagggggaacattcagaaaaatacctaatgtatgcagagcttaaaatctagataacaggttgataggtggagcaaatcaccatggcacatgtatatcttcgtaacaaacctgcaagttcaacacatttatcccagaacttaaagtaaaatttaaaaaaagatatacacaataaaaaaatgtaactcaaaatgaaccatagacctaaacgtcagcatcattttatttctaggagaaaacagaagaagtattctgttatctggggctatgtcttagtcagctttggctgccgtaacaaaatgccatggagtcagtagatgaaacaacagagatttatttttttaacagttgtggaggctagaaatcccaggtcaaggactggtattgtcatttactggtgatgggcttattcctggcttgtagatgccctttgttcattatgtccttcattggcctttcctctgtgcatgtgcatggagagggggtggggagtgctcatgtaggcacaagaatgctttcttgtgtcccttcttataagctcactaattctatgagatcaaggtgccacccttgtgatatcctttaacattaattaaatccttagaggcctcatctccaaatatggacacccttgaaaacgggcttcaaaatatgaatgtggtggaggacataagcattaacaaagaatagacacatagatcagaatagagctaggaaatagacctacatatatatagtcaggtgatttacaacaaaggcaataatggtgaatgtatattttttctaacaaatggagcttgaataattggacatctatacaaaaacaataataattggacatctatacaaaaacaataataatgttaattataattgtaataataataatgtaataattgcataattgtaataataataatgataattataattataaacaaatccttaggtatttcacgaaaattaaccaaagatacatcatagagataatgcaaatgcaaaaactatacaacttctctaagaaaacataagagaatatctacgtaagcttaagtttggtgatgtgtttttaaattcaacaccaaaatcatgatcaatgaaagaaaaaattgccaaattggagtgtattaaaataaaagtcttatgctcttcaaaagacactgtaaacagaatgaaaacaaaagctgcggactaagagaaaacatctgtagtacacatttctgataaacaacatgtatctataatatacacggattcttaaaactcaacaacagaaaaataactgaaaacagtcaaaagatctgaacagatgtttcaccaaagaagatatacagatgacaagtaaacatattgaaggtgctgaaagtcctttgtcattagagaattgtgtgctaaaatgagacaccactacataccttctagaatgtctgaaatccctccccccaccaaaaaaatacaagaccaattgctagtgaaaacgtggaacaacagaaactttcattcattactggtagaaatgcaaaacgactttggaagttaatctgacattttctttaaaaaactaaacatagtcttaccataagattcagcaatcatactcctaggcattttatctagctgattttaaaatttatttctacataaaaacttgtatatgaatgtatacaataacttattttataatcactattttataaaaatagaggcatccaagatatattgcattaggtgaatggataacaaaacatggcacaaccataaaatgagctaccattagtcaataaaaggatatgttacaagccacacaaagacatgggtgagtcttatgctcatattgctgtatgaaagaatacagtctgaaaagcctagatagggtaagatttcacttatatgacattctggaaaaggcaaaattatagatatcataaacctatcagtgggagccaagggggctataagaggagcacaggctacttattagtgcagtgaaactactatgcatgatactgcaatggtggatacaacgttgtctgggtctcaatgtttgtctttccagaaaattcatatgttgaaatcctaacaccaaggtgatggtattaggtatgaggtgggtcatttgggggctgattaaatcatgacagcagagccgtcatgaatagcattagtgtctttattaaacagatcccacagagatcccttgccccgtcttccatgtgaggacatgggaaagagagctgtctatgaactgggaagcaggttcctgccagacacaaaatttgtcagcaaatgttgaacctgatcttggacttcccagccaccagaagcatgagaaataaaattctgtcatttatatgccacccagtctatggtatttttgttcgggcagcccgaatggaccaagacaagggcagcagacatttttcaaaacccacagatgcttacagcacaaaaagtgaagcttaaagtgtgcaaattttaaaaataagaggttggaaaaatcataggacagaatgcagaatgttgcacgtgtgcgcacgcacacacacacataaacctagatgtattataaatgtatgaaattacctcagtgaagcaagtggggggaattatgaggtcgttattactgtcttaataatgttgaaaattagtggagtctgtaagactaaaggccaaaggagctacacagaagtactgcactgtaactgatacaaggtttgtttgtttgtttgtttgtttttcttatggaggcacaacgttatgggttaccaaatccaaatctgctgtatgcacatgctggtattaaactattaactaaatggttagtggatgatgggagacaggtttctcacggatggagtgatagactatagaaaaacaagaagagaaagctagaatgatccttgtggtaacggattagagttgaagacctcagtataaaattgtatttaatttaatatataggcaaatgtttacatatataaattcaacagatgtgtatatacgtggtatatacaaacatatatttcattgttctcagcagagaagcctatgactaaaaactactctgtagcaacgagcacacctagaacccagatgtcgattcccacctagaaccatttcccaatgaagcgaaccagacctctggagaaatagcttagtttagcactggggcagggcataaacaagatgaaccaggagcatcttgtagccctagaaatgaagggctgaagaatatgataaaggacatcacagtgttgcattcagcaaaacccagactatggaaaactgcagagagcgcaagatctgtttctttccaaaaacaacaaaacaatggcagggaaacaggtccagtggaggggacctacagatgacgaaagagttaagggttataacgacaaaaaaaatcactgtataataccgtgtttgggctctcattcaaataaacatacttttacaaagtgtaagtctgccagataagtgtgtaaatcagttaaacatctgataaccatttatttaatttttttagaaatgaaaactgtattgggattttagttaacataaagttcttaacttttagaaaaacatattgaagtatttagagatgaaatggaatgatgtcttagatttgctccacattattccagcagctgagatacaagtaggtgagcctcaaactggaaccagatatgacatgtattgaaggttgttgatgctgagtgacaggtgttctggtttcattatgttattctattattcaaggtttttgaggcgctccctaagaaaaagtttttatcgcaaatttcacaccgtttaaagtgaaatcctatgtgaaactgaacactttgcagaaataaaataaatacatttccaaattggtccaaaaaggaaaagaaaacttaaactatacaaacagaaatggtacaatattcatagctcaagccaccctcaaatgttccagtctaggcagtcttggaggccgattgaacaaaatgatcaggaaaaactaactaccatcttacctcaactcttccaaggcatacaaaatatagactatcgttcaattccttctcccagacttgccctcttggatacaaaaaccagatgaggaccacccccacccatggacaaaaacacatcaaggaagctctcatacataacaccacatatcctacataagttagtagcatattaaatgaacaaacaggctctgcccaaggaaagaaaatatgatttattgttacaaaaaagaaacgtatttcattgtaattccttacatacaaaatggagaagaaaaagataagtgctcatatcactgggtataggaaaagcttttgaaggaaattcaatatgagttcaaagtaaacatatttagttaacttcttttgaaagagaatttccatttactaaaatcaacagcaaacatacataaatgctaaatgttcgaggacttattattaaagagaggaaaaataattagatgtaaggtattatctccagcttttaaatcagtattgagacacaaagtcagagctataaatatcaacataaataaggagtatgaatagtggaaaaaatatataatgtttagtgataacatgatcagtcttgaaaattcaaaggagtaggcatgtggaagattcaagtgaatgggccttcagaatgaggtatacaacagattataatagcaaaatcaaaatctttgccagatgaaagcaatcagtaactagaacacttaatatacaatatgcctttttcaatagcatcaaaatccaagaattacctgaaaagaagcctagtaaaaatgcagaaggtctttatagaggcaacaatcacagtatactgacagattcaagtaaaaggagtttgaaattaatacatgaggctgggtgcgatggctcatgcctgtaatcccagtattttgggaggctgaggcgggcagatcacctgaggtcaggagttccagacacacctggccaatatgttgaaaccccatctctactaaaaatacaaaaattagctgggtatggtgccatgcacctgtaatcccagctactcagtaggctaaggtaggagaatcacttgaacttgggaggtggagattacagtgagccgagatagtgccactgcactccagcctggtagacagagggagatgccatctttctctctctctctctctctctctctctatatatatatatatatatacacacactcacacacacatattatagaggagcatagcatattcattgatgagaaagagaacactgtaaaaatgtcaaatgtgcttcaattatgtacaattatgtacaaattatgtcttacctgtggctgccaacgtgacaatcaaatttgggctgctgttctctgcttcacaaatcaaccctggaaaattatagaagggaaaaagaaggagaaagacacaatatcagcaacaaagtctaagcaacaaaatagagaaagccctgggtgatgctgaagatggttgaactggtaattgtgtttgacacttgcagtctcggttggagggggggtggcagcagggatactggggaggtctgtaccctgcctagactgcagttgacaaaatggttacaatgaaagttttcaaatttccacttcacatcattacacagtctgaggcagctcctcaaaacatgatgctagtagccctagggcaacagcaggacaccagttaaacagggctggttaagacagtatggatcaagagttccactaataacaaccagacaccaacatagtgggtgagaaattgtgtttcaaaaaaaattatttcaacagaacgtaaagaatggaaaagaagtagaataggatataagagtgaatcatgcatactactggtaggtattctttcctagaaataaatacatatatatatacagctacctacatatatccttggaagatacgaaaagtgtatttctttttcattttttaaattttttgagacagagtgtcactctgtcgcgaggcccacgctagagttcaatggcacgatctcgcctcactgcaaactccgcctccaggtgcaagcgattctcacgcctcagcctcctgagcactaccacacccagctaatttttgtattttgtgtagagacggggtttcaccatgttggccaggctggtcttgaacccctgacctcaagtgatctgcccgcctcggcctctcaaactgttgggattacaggcgtgaaccaccgtgcctgggagtaaaacatattactttgaggacaaaaggtttgccaagtgtagctctggctggagagaagcccccgtgggaaggtgtgcgtcttctcccagaggtcactacaatcgcgggagctgccactctgcagggagcacctggcctgggacctgcagccattctctgcaatgggtgcagctgggcaaatgctcagagatggcagaaacagcatctcccgcccatgacttcaacaaagtgccaggagccgggaggaggaccttcctgagtggggacagagggtccactctcccgacgtagatgggccacagaatgcagctcagcccctcctgtcagccctggaagaccctggcaatgttaccacgaccacaccccccctcccattgccacctcatgggactgggggccagagacttggtgggagagaagcagacacaatcggcagagaatatgggtgtccagattctgccaggcatgaaagtcaggaccctgaggggtgaccgagggtcccccaaccccacgcccaaccccactaccaccaacacgacgacttaagccccggggcaccactggcatccctccccctaccacccccaatccctccctttacgccacccatccaaacatcttcacgctcacccccagcccaagccaggcagaatccggttccacccctgctctcaacccagggaagcccaggtgcccagatgtgacgccactgacttgagcattagtggttagagagaagcgaggttttcggtctgaggggcggcttgagatcggtggagggaagcgggcccaggctctgtaaggaggcaaggtgacatgctgagggaggactgaggacccacttaccccagatagaggaccccaaataatcccttcatgccagtcctggaccatctggtggtggacttctcaggctgggccacccccagcccccttgctgcttaaaccactggggactctgaagtcagagctcgtgtgatcagggaagggctgcttaggagagggcagcgtccaggctctgccagacatcatgctcaggattctcaaggagggctgagggtccctaagaccccactcccgtgacccaacccccactccaatgctcactcccgtgacccaaccccctcttcattgtcattccaacccccaccccacatcccccaccccatccctcaaccctgatgcccatccgcccagccattccaccctcacccccacccccacccccacgcccactcccacccccacccaggcaggatccggttcccgccaggaaacatccgggtgcccggatgtgacgccactgacttgcgcattgtggggcagagagaagcgaggtttccattctgagggacggcgtagagttcggccgaaggaacctgacccaggctctgtgaggaggcaaggtgagaggctgagggaggactgaggaccccgccactccaaatagagagccccaaatattccagcgccgcccttgctgccagccctggcccacccgcgggaagacgtctcagcctgggctgcccccagacccctgctccaaaagccttgagagacaccaggttcttctccccaagctctggaatcagaggttgctgtgaccagggcaggactggttaggagagggcagggcacaggctctgccaggcatcaagatcagcacccaagagggagggctgtgggcccccaagactgcactccaatccccactcccaccccattcgcattcccattccccacccaacccccatctcctcagctacacctccacccccatccctactcctactccgtcacctgaccaccaccctccagccccagcaccagccccaacccttctgccacctcaccctcactgcccccaaccccaccctcatctctctcatgtgccccactcccatcgcctcccccattctggcagaatccggtttgcccctgctctcaacccagggaagccctggatggcccgatgtgaaaccactgacttgaacctcacagatctgagagaagccaggttcatttaatggttctgaggggcggcttgagatccactgaggggagtggttttaggctctgtgaggaggcaaggtgagatgctgagggaggactgaggaggcacacaccccaggtagatggccccaaaatgatccagtaccacccctgctgccagccctggaccacccggccaggacagatgtctcagctggaccaccccccgtcccgtcccactgccacttaacccacagggcaatctgtagtcatagcttatgtgaccggggcagggttggtcaggagagggcagggcccaggcatcaaggtccaggcatccgcccggcattagggtcaggaccctgggagggaactgagggttccccacccacacctgtctcctcatctccaccgccaccccactcacattcccatacctaccccctacccccaacctcatcttgtcagaatccctgctgtcaacccacggaagccacgggaatggcggccaggcactcggatcttgacgtccccatccagggctgatggagggaaggggcttgaacagggcctcaggggagcagagggagggccctactgcgagatgagggaggcctcagaggacccagcaccctaggacaccgcacccctgtctgagactgaggctgccacttctggcctcaagaatcagaatgatggggactcagattagcatgggggtgggacccaggcctgcaaggcttacgcggaggaagaggagggaggactcaggggaccttggaatccagatcagtgtggacctcggccctgagaggtccagggcacggtggccacatatggcccatatttcctgcatctttgaggtgacaggacagagctgtggtctgagaagtggggcctcaggtcaacagagggaggagttccaggatccatatggcccaagatgtgcccccttcatgaggactggggatatccccggctcagaaagaagggactccacacagtctggctgtccccttttagtagctctagggggaccagatcagggatggcggtatgttccattctcacttgtaccacaggcaggaagttggggggccctcagggagatggggtcttggggtaaaggggggatgtctactcatgtcagggaattgggggttgaggaagcacaggcgctggcaggaataaagatgagtgagacagacaaggctattggaatcctcaccccagaaccaaaggggtcagccctggacacctcacccaggatgtggcttcttttcactcctgtttccagatctggggcaggtgaggacctcattctcagagggtgactcaggtcaacgtagggacccccatctggtctaaagacagagcggtcccaggatctgccatgcgttcgggtgaggaacatgagggaggactgagggtaccccaggaccagaacactgagggagactgcacagaaatcagccctgcccctgctgtcaccccagagagcatgggctgggccgtctgccgaggtccttccgttatcctgggatcattgatgtcagggacggggaggccttggtctgagaaggctgcgctcaggtcagtagagggagcgtcccaggccctgccaggagtcaaggtgaggaccaagcgggcacctcacccaggacacattaattccaatgaattttgatatctcttgctgcccttccccaaggacctaggcacgtgtggccagatgtttgtcccctcctgtccttccattccttatcatggatgtgaactcttgatttggatttctcagaccagcaaaagggcaggatccaggccctgccaggaaaaatataagggccctgcgtgagaacagagggggtcatccactgcatgagagtggggatgtcacagagtccagcccaccctcctggtagcactgagaagccagggctgtgcttgcggtctgcaccctgagggcccgtggattcctcttcctggagctccaggaaccaggcagtgaggccttggtctgagacagtatcctcaggtcacagagcagaggatgcacagggtgtgccagcagtgaatgtttgccctgaatgcacaccaagggccccacctgccacaggacacataggactccacagagtctggcctcacctccctactgtcagtcctgtagaatcgacctctgctggccggctgtaccctgagtaccctctcacttcctccttcaggttttcaggggacaggccaacccagaggacaggattccctggaggccacagaggagcaccaaggagaagatctgtaagtaggcctttgttagagtctccaaggttcagttctcagctgaggcctctcacacactccctctctccccaggcctgtgggtcttcattgcccagctcctgcccacactcctgcctgctgccctgacgagagtcatcatgtctcttgagcagaggagtctgcactgcaagcctgaggaagcccttgaggcccaacaagaggccctgggcctggtgtgtgtgcaggctgccacctcctcctcctctcctctggtcctgggcaccctggaggaggtgcccactgctgggtcaacagatcctccccagagtcctcagggagcctccgcctttcccactaccatcaacttcactcgacagaggcaacccagtgagggttccagcagccgtgaagaggaggggccaagcacctcttgtatcctggagtccttgttccgagcagtaatcactaagaaggtggctgatttggttggttttctgctcctcaaatatcgagccagggagccagtcacaaaggcagaaatgctggagagtgtcatcaaaaattacaagcactgttttcctgagatcttcggcaaagcctctgagtccttgcagctggtctttggcattgacgtgaaggaagcagaccccaccggccactcctatgtccttgtcacctgcctaggtctctcctatgatggcctgctgggtgataatcagatcatgcccaagacaggcttcctgataattgtcctggtcatgattgcaatggagggcggccatgctcctgaggaggaaatctgggaggagctgagtgtgatggaggtgtatgatgggagggagcacagtgcctatggggagcccaggaagctgctcacccaagatttggtgcaggaaaagtacctggagtaccggcaggtgccggacagtgatcccgcacgctatgagttcctgtggggtccaagggccctcgctgaaaccagctatgtgaaagtccttgagtatgtgatcaaggtcagtgcaagagttcgctttttcttcccatccctgcgtgaagcagctttgagagaggaggaagagggagtctgagcatgagttgcagccaaggccagtgggagggggactgggccagtgcaccttccagggccgcgtccagcagcttcccctgcctcgtgtgacatgaggcccattcttcactctgaagagagcggtcagtgttctcagtagtaggtttctgttctattgggtgacttggagatttatctttgttctcttttggaattgttcaaatgtttttttttaagggatggttgaatgaacttcagcatccaagtttatgaatgacagcagtcacacagttctgtgtatatagtttaagggtaagagtcttgtgttttattcagattgggaaatccattctattttgtgaattgggataataacagcagtggaataagtacttagaaatgtgaaaaatgagcagtaaaatagatgagataaagaactaaagaaattaagagatagtcaattcttgccttatacctcagtctattctgtaaaatttttaaagatatatgcatacctggatttccttggcttctttgagaatgtaagagaaattaaatctgaataaagaattcttcctgttcactggctcttttcttctccatgcactgagcatctgctttttggaaggccctgggttagtagtggagatgctaaggtaagccagactcatacccacccatagggtcgtagagtctaggagctgcagtcacgtaatcgaggtggcaagatgtcctctaaagatgtagggaaaagtgagagaggggtgagggtgtggggctccgggtgagagtggtggagtgtcaatgccctgagctggggcattttgggctttgggaaactgcagttccttctgggggagctgattgtaatgatcttgggtggatccagggccagattctcagacggtgagagaaaagcctggaatggaaagctgctctgaggagtttctttcggatggtggatgaacagaggagtctccacctgagcaggattggaaagtgtcctatgcttttgtgccagtgcttctgaacacagcgcaagagctgcgtgatggacactcatcatccgaaagcatttcctgagagagaagcgtgaatctccccggaagggagacccagaagccactggccaggcacttttctgcctggctgggaggaccagggctgactctattaaaaaggcatcctaatgaggttatctcacgtgcaatttggccagtcgtaagcaagatttcgtgtggtgacaaaatgaatgaaaatagtggtttggatggaaaggtctgtgggagagaggaaaggagttggtttttgactcaaattctacgatctttgagctgcatctggctagggaaactcacatacccaaattttgaagttcattctctaagaggaaatactttactgaattttatggatgaaacttccctttttggttaattattccatgtcctattaagttgtatattctctgataagtcctggagaacaacaacaacaaaatcccagagtggtagagtctgggctcaaataatattagcaataacagccacctgctagccattaaacttgtaatttactccaggccctgagccaggtgcttcacttgcatggcacacactccaccagtcctagcggaagggtctaatcacacctactacacagatgtagaaccagaggcacgcaaggcttgggtatttcccaggatcacacgcctagtaagggacagggctggaaccggatcctggacctgaattcctgcagagcccatgttgttcccactcctcccagcccgtggcccacctcctgagtaatacttcctttctcttctcaacactgtgccgtatgtctctggtgacaaaaagaaggaccccgaggccagcgtactaaaaacaggcctggggaaggtgacagtgagaatgaaacaccatttgaggctggtgtgcactgggttccttgacagctgactctgccaaggtgtgggcatttctgtcagtcccagcactttcccgaattgcagtgagtttcccctggccacttccatgtgtcctgtctcactctggaacacgggttgctgaccagcttgtcactagtccccacagaacagcccagaatcacctgctcaccccatgacaggccacattccttttccttgtagaagtcctctggatgtcccatctctcacccaggaagctatgtgatatcaacaccccttttgaattcccatgggatagtgatgtttacacacctggttaccactctgcttatcttcagtacactgtccaagtgctttatgaatgtgctgagtagagtctgattcgccatattatctaagcgttcttgggatgtcgccatgaaattagaaggttttggaaccaccttgatacttgaaattggactttatcagggtgtcttatttggagtttacctctgagcacatacacagatgaatgctttaaaaccaaagcctccctcatgagtattagatgaggggaagctttggaaatcagtggaacaaacatctacttactgaactcctaaatccctggaggccctgattccttgaagacacttctgctctgatggaaaacgaataattaagcagctttctactgctgcttgtctgtttaactgcctcgcaggaaaatactggctttcagtgtgcctagagacacctgacacgagttcagacatgtggagggtagcagaaactcacaggttaagattttgacctggaatcaaatggacaaaaaaattgcagtctactcaggattcaaagggtcatgcaaagggaaggcttcctgctgagactttcaagattcttggacagttagttgtgatcctatatttgaaagcattgttcacatattaggcactggaaacaagttggagaacttcaagccaaatgtggccttttccgaaactcctttgagaaatgagaagggtagtgtaatgccaaatactaccaaataatcataattgctttatttatttacttatgagggattctcgctctgttgccccggttggagtgcagtggcatgatctcagctcactgcaacctccgcctcctgggttctagcaattctcctgcctcagcctcctgagtagctgggattataggcacccgccaccatgcccacctaatttttgtattttagtagagatggggtttcgccatgttgaccaggctggtctcgaactcctgacctcaagtgatccacctgccttagcttttcgttgtgcagctactaagtaacagtttatgggggagactataatgctcacccacatcttgtctccttcccctttctggacacatgggaacagtaaggcccacttacagttaggaagggtcacgtgacttttccttgccaccaaaacatgaacagaggtgtttgtcacatcccggcatgtgagagccagtgtgccatttccacactttctccctcctttcaatggtaaacagggcagcttcattttgacatgatggaatcataaggtggaagcagcccggatccctgggtcatgtgagagtgaggagcccctgccaaaccgcatcagaacttaggtgcgcatataatacacttgagttgtgtcaggctattcacatttcaggacttgtctgttgcattaactagtagttacttaaactgacagagctactctttctgttgttaggtataaatatttttacttaaaaggttgtactgtgtatattcttagggcaaaaaatatagaaatatagataatacacaaatttcccctttacaaagttcctccacagtttaacccgctcctcagaggtcaccacaatgatcagtcttgtgtattattttacagctgactacaggcttttcatggacagataaagtacagcaatatgtcgtttttatttaacatgcaagaagagtgatgtacatattgaactgcaactaacctttgtcagtttataaaatggatgcgggatctttctaaacaatacatatatagatctatctcacttttcaaattacattctataattctaaagtaggcatacaccataattaattaaactctttctgaaagacacataagttgtttctcatttgctatatgatgactagaataagatcaacatctttgagtataaatttttgggcaagcatgagtgttttcttataagaaagatgtataacatggacatcgggttaaagtgaaaagggtggcagactgaacaggtgccagggaaggacagcagacaggagatcctcagcccgtgaggggcactgggaggatccaggggagagcaattgccagcgtccatgagagagaccacatgtgaaaccaagtccacagagccccaggcaggctggcattcacagctgtgaatccagagttcagcccagtgggggcagggacctgaggaaggcaaggcggaagggaggagggaggacaggacaatgaacagaaatagtcttgggaaatccaggcaccatcatcaccagctggagggggtcgtgtgatccgaatgggcaggcctattggctgaatgcaccagcggcatgctggacaccccaccctgcctcagactccccttccttctctcagcaagagcttggctggctccctgcatcatcctgggctagctccctctcctgacccctccagtggtcctgtgcacctttgccagcgttccagggctggaagctgtcttcatgcctgctgggggctggagttttatcccctggggaccgtccatagaggctgggctatgtgagtgggttgctgactgatgaccaactgccgagatgggccaggaatgccaatgagccgttgaagggggcatgtggccacatggaggggaaattggaggaagagtgccctgagactaatcagtcgagactctgcagatgaagggctgggtgtggacgtgcgctgaaaatgatccaggtggtgaccctgcctcagatggactcctgtggcttctgagctcttggcgcacaagggagcaggtgtcccggcgctgtgattgctggcctgtgttgccctcacacactggctgggatagagggctggcccaaggtgtggacataggcaggttggatggaaacccagtggagttggcaccttcccttgttaaactgatggggatgtgcagggttcaatgcagggagcatcatgcaccatcctgctgggaacatcctcacctccatgacagtgtttgggcctggtgaggaggcgtccgtagtagccctctcaatagaagtttccacgggaactgtgaactcaggtgagcacaggtgagggaactgtgcatttctttatggaggcaggaggcccagatggggcagactccaagatttgaatcagtgaattcccatccctggtaatttcattcattcattcattcattcactcactcacttactcattcatccattgattcatccatttattgaacatatgctgaggaaacaccaagtcatgaaaacaaaagaaagtggcaatgttcttagttcagtctgtcagggtgggggcagatggtgaggtggaaagccacgtgagtgttttaggaagtgagggactgtgaactgatggagacaatctctattgatctgacttctgaggctgctgactaggtgaagttgtccccttagttgagagtgaaggaggaaaagttggtggtgatttgatgaggaagagtgtggaggacggggtccatgtgcagtatgtagatgaggaggtgctgtgcctgtccagatggagcctttgcgtgagcagtaggaaaatgggtctgtcaatttggatgggggccagggcaggacattaggtttggctgcatcagtaagggtggtctgaggccgtaggtttagattaaacagactgttgtgcagattgtggcccacatgcttgtattagtcagggttctccagagaaatagaagcaatacgttatgtttttatataatacataacctatataatagggactaggaaaggagccactggtgtaagtcctggagcctgaaggcacaagaaccaggagttccaatgtctgagggcaggtgaagatggatattgcagctcagaaatagctcagaaatagagctcatccacccttcctccaccttttgctactctctgggtccttaatggattggatgaggcctgcttacattggtgagggcaattttctttactcaagtgtactgattggaatgctaatctcattcagaaataccctctcagccacaccagaaataatgctttgtcagctatctgggcatcctttagcccagggcttcccaacccatgggccgtggaccagtactggttggtggtggcctgttaggaaccagcacacaggaggagatgagcagcaggcaagggagcattgctgcctgagcttcacctcctgtcagatcagcagtggcgttagattctcacaggattatgaactctattgtgaactgtgcatgccggggaactaggtttctcactccttatgagaatctaactaatgcctgatgatctgaggtggaacagtttcattctgataccatctccccacacccacccacctccctactcaccccacccccagtccttggaaaaattgtcttccaggaaaccggttcctggtgccaaacatgtgggggacccctgctgcctcagcctacccaagttcacacatacaattcatcatcacaactctaccccatgtcaccttatgtcaccttggcacccatgtgcagcttcttaaaccatagttactcatcaaacaaagaccataccaacatcataattctgtctaacatgatacaactatcctgcctacaaccaataccaatccttttctcaggagaggaagtaaaatccttaaatgatgtttttttcagctgatatcgcataacatgaacatagcatcatgtaaaattaataatacttaaataccgatgaaaagtcactgcgtcttacgttacctgataaggaaatatgagaggaaagaaaacaaagatctttgcttaacgtcacacacacacacacacacacacacacacacactcataataaaataacagtgaaatgacattttgaagtcacagtgactgccccagctagctgataatactttgcagagctggagcaaagtcctcttgaaggctgtatgtgctctgaatcagcattcaacatatgatgtcgtctctatcatagccaggattcactggtccaggaatccaggggtggaaattggagtggcaacattcagcatcacccctagaggctcactagtaaatgttttgcttcctgtttccacaacaactttatgctctgctggctagaggtcttagttctagaggaaggaatgttgccaccaggagacacaacagtgatttcatggaactagaaattaagactgacacccagccactttgggcttctggtgcctctgagtcaagagggtaagaagggagtaagtgtgttgcatgcagtcattgatgtcgactaaacgggggacattggaggatgactccacgatgaaggtaaggaagaatatgtctggaaaacaggggatgccttagggtgtctcttagtattactataccctgtgattaaactaaatgagaaattaccacaacccaatccaggcagaactgtgaatggctagaccctttaggaatgaaggtttgtgttaccctaccaagtacagaaccccgaccagctgaggtgcttgctgagggctaaaggtatacagaatgtgtagcagaagaggatgcttataaaacccagctaccatattgtgaccagtgatagaaatgagaattataataatcatgagtatttcctcgctattttattgtgaatacgcttgtcagcaaaacctagagtttgatccaagttgtgtgtattagtatgttcttcttctttttgttgctgagcagtataccattgtaagatgcagcacagtttaaccaacacccatggaagggtatttgggtgtgtagaaaatggaacctttttagggcatgcaggaaagggaacccttccacaccactggcaggaatgtgattggtacaacgttatgaaaaacagtataacagttcctcagaaaataaaaattgatccaccacatgacccagaaatccatcggttgagtatgcattctccccagaaatgaaatccacaacatatagagatatctgcagtaccacctaattctaacttattaatcctacaagaaataagtgtttctaattgaaaataatgttttttaaccaccctgccatcaaatatttattctaattatctctccttatttcttgctatgtaataacctaggtactactgcccattgacagaactaactaattattccaacaagaactcagaagtgttgaaaagaatgcaatttcattctttctaccctcaaccagctattctagttttatggaggattctgtatttaactcttacccatgtaactctacttaccatattcatggcacctagtcaacaatcctaaagatgataagaacacagagttgacaaagatggttactcaactttgtacgttcaaccagatttccaggtaattgggaattgtttattcaattatttgccaggtatgactggggggtctggaattatttcactaagacataagaagtagtactgaggagaatatgtttattctaggtactggcttcatctagttatctctacttaattattcaccttggtaaaatagatatctattgtatgaggtaatatttgtaacactaggttgggatttggcaaggagaaaaacggttattcaactctctggcataagcccattatctttagcttcctgagatcaattacttggtctggctgtttttattaggttggtgtaaaagttattgcagttttcgccataactaattgatatctttaggttactaaatacatgtttactgtcagatgtctgtggtaatttattatcccaacaaaaaataatagaatgataaagaaggtttttccttatcctggcatcacacagagattcaagttatctacagttatcctccataacttttttcctatataacactcagcacctgtcctttgaagttctaagctcttgtccccactaaaactaataaatcaaatgtgagttgcagagagcatgattttcaggatcaggcttcacttggaaatgtaatgattggtagctgtttctatgtaacaagtttcttgggaaaacccagttaagtcgaacttattaatacgacaacgacaaaattatatttgacaagaacaggttccctattttttgcattccacttagtatccttgttgtctctattttactgcttacttaggtacatgacttacctatagtactaattcactgttaaatgtatataatgtgtagtgattaagtcagggtaattagaatgtccatcacctgagtacaatacttttttgtgaaggactgtcaccctactctgctatcaaacaatgaattcattgcttctatcttactgcaggtttgctcccttcgacccatttctctttgtccttccccctcctgactcactcttcttaatctctgttctctacctctcaactctgtgccaccatgcaactagaatttttagctcccacatataagtgaagacatgtgatattcgtctttttgtgcctggattatttccctgaaggtaatgacctctagttccatccatgttgctgcaaatgacatgatttcattctttttttttgtggaagaataacatttattcattgatgggcacttatgttgattccacatctttgctattgtggatagtgctgtagtaaacgtgcaagtgcaggtattttttgaaatatcaatttattttcctttgggtagatacccagtagtgggatagcctcatcgaatggtagtacaattttttattttattttttaggaatctccatactgttttccatggtggctgtagtagttcacattcccaccaacatggtgtaagagttcccttttctgcacaaacttgtcaacatttgttatttttttcttttgaaataacagccattctgactggggtaagatgatatttcattgaggttttgatttacatttctctgatgattagtgaaagcagacacctatctctccctgtatatgaaaatcaactgaaaatagagtgaagacttacatttaagacgtgaaaatataaatactagaagaaaacctagaggaaaatctcttggacatggtctaggcaaagaattcctgagcaagacttcaaaagcacaggcaagaaaagcaaccaaaagtagacaaatgcagtgcattcaactgaaaagattctgcacagaaaaagacataatcaacagagtaaagaaacagcctgttgaatgggagaagatatttgcaaactatttatccaacgggggactaatatccagaatacattaggaacacaaacaagttaacaggagaaaaataactcatttaaaaagtgagcaaagattctgaatagacatttccccaaagaagacatagaaatgatggacaggtatattaaaaaagtgcttcacatcactcatcatcagagaaatgagaatcaaaacccatactattgtattagtggaaagtacagggctttttattagctaacctctggaagactaactttatacaaattcattaatgcccttggcaccattgttagaagccagaaacttggtgtaatgatctgtagagggggagtcattcaatacctgtgttttcctgcccttagatgagaatggaaaggtgtccattggatttactctcaaaacattaagatagacaagttctactttgctgctagatatgtcgtaaaatgatataatgcaatctggattactcatggagcagatactccatattttatgttctttattgctttctcacttttcacattttactttactaacctccatggactgtatttgcaaaaagaagatgatggtgtcagaaagtcaccagatggaggagttgagctgccactgctaatgtcaaccaggcagtccctgacaaatagtgtgcgggcatatgagaacaacctggataacatttccaatgcagatttaatgttccctcccacagagttcatttggtaggcctgaatagggccatgaaatctgaactttgccatttccctttcactctgatcctgatacaggctggtccacgagccatactttgagaaactttgatgtcaatggtaattgtagccatggccatatattatataaaaatgtttagagagagagtataaacttggaagagaattgagtaaaaccaaatcgcttggaatcccatcttgaaaaggccccgtggaggaggtgctgctagtaaagatattgagaagtggccaaaatgaagagaataacaggagaatgtgttgttatggaagacaaaggaagacaaaaggagaggaaagagaaaaagaggagagtgtgcaacagtgttgactgaagctgagaatcaactgagatgagggccagagaatgtccattagctatagtcacatggaggtcaccagtgacttttgagggagagttttttttttttgaagagatgtgtgggcccacgttggtttctagcgggttacagaaaatgtgagaggtgaggcaatacaggcaccaagtagagataatcctttggaaactctgccacaaagagtaagagagtggtgggaattacattggttgtgaataacgcccaggtgttttcaagttgaaggagattcaagtatgtgctaatggaaacaagaaagacgcaaaaagaaagacatactgaagatagaggaaggagaaagataatggataaaccaatggatgacatgaggttcctggaagacaggaggccatggaacatgtagaacacaggggcagggacatctctgctcctctaatagatcaggcacagatgcaggtagcttgtaggtttgatggcagaagttttgggggtttccatttgaattgtcagaaaaacaggaatagggtcaaagggtgagtgtaacagggcgttgggaatgtagatagccgacttgaagggtgagcacagcagaaaaggcagcagaaaaaaaaaatcacagttgggagaatgagttgaccaggtggaaacaggacacttggggaccattttgagggcctaattgagggtggaaaacaaatacagtcaagagggtaaacactggccatgttaagtaatttttccacaggcacagggacaggggccagcaatgcaaaagtttttttttttttctagaaataagacttttcctgacaaatgcagtgaatgcacaagaaattattgggaggtgactgacagaaacattggactttgaatctgagaagacaggaaattctcaaggatagaggaacagggaaaaggtcaatggagtagcagtccagatggagtagaagtctagtgggatcacagggctaagcgagctggaaggtgggatttcatagcatttttatgacctagtctctccagacacaaatcatcacttgtgtggtcctctctcagtctgagcagtttcagatgctgcctcagttcaagagaaggacatatgggctccactccttgataaaagcagtgtcaaggtcacatggaaagaagagcatgggggagagaagatggtgttgtggccaactcctgaaaatgcaatttgccacaaccagttaaacggccaaaaagaaataacagtgaaatttgtaaattgtttttaatttcaatttttaatctttgtgggtacatagccggcatatatatttagagggtacatgagatttgtttgtttgtttgtttttctttttgagattgagtctccctctgctgccccagctgcagtggagtggtagcttatagctcattacagcttgaccacccaggctcatgcgatcctcctgtctcagcctcccaagtagctgggtctacccgcacaaaccatgcgtgactgttttttctttttgtttctgttttttttagaaacgaggtttcactttgttatccagtctggtcttgcgctcctgtgtgcaagcgatcctcccacctcggcttcccaaagtgctgggactacaggtgtgagccaccacaaccagcccagcgtaacactgtaaacatttttgaaaatgtagcactaatgtatatgtataaaaactgcagcatgagaccgggacgcggtggctcatgcctgtaatcccagcactttgggaggccgagacgggtggatcacgaggtcaggagatcgagaccatcttggctaacgcagtgaaaccccgtctctactaaaaaattacaaaaaattagccgggcgtggtggcgggcgcctgtagtcccagctactcgggaggctgaggcgggagaatggcgtgaacccgggaggctgaggcgggagaatggcgtgaacccaggaggcggagcttgcagtgagccgagattgggccactgcactccggcctgggcgacagagccagactctgtctcaaaacaaataaacaaataaacaaactacaacatgataccagaaaatacaccttctctatcatacaaggaacatttacaaaagttgatcacatatgaggtcactaagaaaacatcagtaagttccacgaaataaagaaatcacaaattacatgccatcgtcatagtatactacaactaaaagcaataaaaacctctccccgctagactagaactcataaatatcatctgttaaaagaatattggacgccagtggagataggagatgagattatataatttctgataaattaaaataaagtctacagatcaaaatctatgagacatatttaaagaagcgatcagagaaatatgggcagctttgaatactcatacccatgacaatgaatgagggaaatttctaactcaaggacaagacataaaatttagaaagaaaattatttcttttggcttagtaagacaaaagaaagcacaagaaagaaataacattaatataaacagcagacattattgagggagaaaacagaaagatgagatcaagaaatgaagtcaagatgttctttttaaatcattgaagcagatgaagtagcagctaaatgaatcaaagtcatagagatagtgtttctatatatgataggtaggtaggtagatggctagatagatgatagatagatagatagatagatagatagatagatagatagatagatagtcagatgtattgcacagcagaaatagaactaccagaacacctcatttgattgtgctttactttattgcacttgacagatacagcttgtttttgacgctgcattgagcaatctgtgggcaccatttttcacagcatgtgctcacttcatatctctgggtcacattttggtaattctcacaacatctcaagtgttcgctaggattatatctgttatgatgatctgtgatcagtgatctttgatattgctattgtaatcacattgggaagcgacaaaaatgcaccctataagattgaaacttaatctatcaacgtgtgtgttttgactgctccactgactggccttttcccatgcctctccctctcctctggcctccctactccctgagacacaagagtattgaaactaggccaattcctaaccctacaatggcctctgaatgttcaagggaaaggaagagttgcacatctctcactttaaatcaaaagctagaaattattaagattagtaaggaaggcatgtcgacagctgagataggctttctgcatgaaaccattagtaacaatgtgaaggaaatgaaaagtgctactccagcaaacacatgaatgataaggcaaaacagccttagtgctcatatggagagagttttagtggatagaccatcaaaccagccgccacatgaccttaagccaaggcctcatcaagagcacactcctaactctcctcagttctctgaggctgagagagatgaggaagctgcagaaaaaaagaaaaaaatgtgagaagctggcagatgttgactcataaggtgtaaggaaagaagctgtctccatcacataaaatcgcaaggtggagcatcaagtgctgatggaggcgctgcagcaagttctccagaagatctatctgagatcatgggtgaaggtggctacgttcacaacagattttccttccagatgaaaaagccttctattggaagaagataccatttggactttccatagttagagaggagaagtcaatgcctgactccaaggttcaaaggacaggctgactctcttgttaggggctaatgcagctggtgactgtaagttgaagccaatgctcatttaccactctgtatatcctagagcctgtaagaatgatgttaaagctactctgcctgtgctctagaaatgaaagaacgaagcctggaggacagcacatctgtttacatcatggcttactgaagattttaagcccactcttgagacctactgctcagaaaaaaagattcctttcaaaatattaccactcattgacactgtgtctggtcactcaagggctgtgatgaagatataccaggagatttttttatttttatgcctgctaacgtgcatgaaaccttcactctgcagcccatggatcaaggagtagttttaactttaagtctccttatttaacaaacacacttcataaggctatagttgctacagatggtgactcctctgatggatttgagaaaaagaaattgaaaactttctggaaatgattcacctttctggatgccactaagaacactggtgattcataggaggaggtcaaaatatcaacaacattaaagggaagaagttgattccaaccctcatgaatgactttgaggggttcaagacgtcagtgagggaaataattgcagatgtgatggacacagtaagagaatcagaaagagtaatggatcctgaggaaggaactgatttgctgcaatttcatgatcaaacttgaatggatgaggagttgcgtcttatgaacgaacaaagaatgtgtgtcttaaaatggaatctactcctagagatgatgcagcaatgtagttgaaatgacaccacaggatttagaatattacatgaacttagttgaaaaagccgtgacagggtttaaaaggatcggctccaactttgaaagaagttctactctgggtgggtaaaatgctttgaaacagcatcatatgctatggagacatctttcatgaaaacaagagtctctctatgtgtcaaacttcattgttgtcttattttcagaaattgcccctgctaccccaattctcagcaaccaccatcctgatcagtcagcagccatgaacactggggcaagactctccaccagctaaaagattatgtcttactgacggctcaggtgatattaaacacttttaatacttcaatatttttaagttaaggtatataaatttagacatagtgcttttgcacacttaataggctatagcatagtgtaaacttaaacttttatacccaagaaacaccaaaaaatccgtgttgcttgctttattatgatggtctggaactgaacaccacaatatctttgaggtatgcctgtaaattataataaagaggaaatttgtaaaaaccaaagggatgtctttacgcatctctatgtggatacatttgtaacactctatgaacaatgtaatttcttgtcaaaatacattttattgatcccaatagcgcccaaaaggttaaaagacaatttctacaaaggaaatagcattgtgaaggaaataatccataggagaccatcaggcaccgattccttcacagggactttctccaaacctttagggccaaatagttgcagcacttaatattgctttgaagactagaaaatgaaggtaaacattggacttcttttttaggaggaagtagaacaatattccctaaagctgataatggcagcatcacagatgggccaatgttgcttctgaacattaatgtggcaatcctaaataaaatattaccaaacatattcaaaaatcacaatgagaaaatggtacaccatggccaagtaggatttattctaggaatacaaagtggaatattagcaattttaaaactttgccatttaataggcataaggaaaatattgtacaactatcttcacagatactaaaaaatggcaaaatttgaaaaaaattataatcaaaattgaatgctaaataatggagaaatcctgaggcattctagtaaagaagcaggcaaaaatgtttaatgtgtccattattacctatcattgtcctgaaggttgtcacatatgcaaggagcaagacaaagaaattagaagcaaaagaattggaaaacaactaaaattatctctagttgcaggtgacgtcataatatacttggagtaccctagagaatcaggggtaaaagtaactaaaacattaaaaaaaatcagaaagttttcagtatataaaattgacacacaaaaaccaacagcctccacagacacaaaaatataaccagttagaagacaaaagttaaaaacaaaacaaacttcatttacaagagcaacaaaaacggttttaaaaataggcataaaattaagacatattcaaaacagtataaaatgccttttacaaagacacaaaagtagagttggactagtgggtagaaatcccttgttccgtgtgaggacattataactaacatcatcaagatgttacttctccctaagtgagttttaagtttattacaattcctcttttgccctggagagaacaagatgatattataatgcctatttaaaaaggcaagtatagctacaaaatcaccgaaaaggaagagctatgaggaataagtggcctaaaacatattacagtatacacctgagcttctgtcattaaaacactgtggattcgctggcatgagaatggacagacaggccaaggcaacatactagaaagtgataagcagacccaataatatgtgtaaattgagagtatgaaaaaggtagcatttcaaatcagcagggacaaagaaggactttttagtaaataagctgataatgggaaaactatacagtattcaactaatgaggacgagacaactaaatttccacgtgaaaaaggaaagcagaattggatctctacctgacatggggaacaaaaaatcaagtgtagataaacacagagttaaaaatgcaaaataatacctcaaaatctttattagaaaatagaggagaaatttgatgacttctgagtaaagatggatgaggaacagctctattcattcctttcagtgtacccagtttaagtcacatatcagtggtctttttttaggttttattttaggtttggggatacatatgcaggtttgtgatacagataaattacgtgtcacaggggtttggcatacagattattttttcacccaggttacaagcatagtacctgatgggcggttttttgatcctcaccctcctcctactgtccacctcaagtaggcccaagtgtctgttgttcccctcttcgtgtccatctgtactcagagttttaaatatgagtttttcatattcctaatttagctattctattgtcatagccttctgattttgtttgctttaaagtaccagagaaaattgaattctctaaagtgggtattttctattattattgcactgataaactgtgtagtagaaaagtaaatacaacttttctaccagtgagaaacatgtaattggatccaaaaactcataaagtgtatattgccacgtgaaagcctggttgcactgactgttacaggaccatatttccaaaaacgtttgagaaaatttctgtagagactatggagacaatactcttatatttaaaatgttttgttcctttttttttttgttcttctatagagataactcatacaagcagtgtatttggggagctttgctctgctaggtggtgacaaagtgctggttttgtgagctgcctaataagttgagtattatagatgggtactgtatgtaaaaaatatttgtattacggtgcagatcttttatgattgctgaaaactattaatagcaattgatggtagatctctgatgtgaaaccaggtttaggaaagcattccttgcagtattacagttttctgagacacggcactatggataaaaatgtcacataagaagctccaagaaaatatttcagaagtgttcgagaatgtatttgacttcttaaacttaaatttttatacacatggacattgcttcttttattacaatacagttaatagcattaatcactagagtgcttaaaaatagttttcttattgtgtattatttctacccttttgatggtcttattaaataagatacttttgtgtgctttacataatgagtcgtgacagtacttcacggcaaagtgtcctttgaattgtaggacattttctaaatgtagaaattaaattctgtgtttgtaaccctttccgtacattttaaaaatagaagcttttaattatttgcttttcatcatctgtcaattaaaagtgatttgcagttttaccatttggaattggaatactaatattaatacctgaaagattttacagaaaataagtgggaaaatcttgctttttgaaatgattcttgcattttacatttcaaatgtccttctaatattaatgaaccatcatgtcccatatcgatttgaatatattccaaggaactacttttcaacattaacttttaatgcattttcacttactatctagctgacatgcatgaaacggggtctttctgcaaagagaaaaaggcttgaaacatatacaaaagcttgcagcaacaccaagaacagaatggaacatattttgaaaacacaacaactgaaaaggtatgattgctggcttttttgcacaatgatatttatatcatttctttgtattcgttggtgcaaatcatttcagtgtcctgtacttattggcgtctccagtgaacaacgtatttcacttgattgttccctaagcaggtaagtttctttagttttataacctcagtttaacaaaattatgagatattacgtagaagccaatgaagatgacctcttttcgccttccagatagcaatagtcttcctgtataattaatttttatcaatttctagaaatatgctagctaaatgtgaggtaaatgtcttcaacgtttagttttagatccttaacaatattccattatgtagaaagggataaccttatgttttaaataagttatctattttagtgcaattgttttcgctatttcttttacaaaatcactgttgtgtcagagtggagaaatagttcagtgaaatatttcttttggaaaatcttacgggatgactggccatgatagtcttgaatttacttatgggaacccccacgttagtcagtaagaggaaaggaaaagtaaactgctcttagagaaaatgaatgtttctggtaaatttttagtgcagtaaaccctcctttgttttcagtacgtaaagaacataagacagctgatctagtagtcagttaggaagaaatccttttggaatgagagtaactcatttccccttttcccaatgagaggatttcagttgctattactcccttgttactttgccacccaggttgttctatttgtagtataaattatgtcaaatcagttttggcttgaataggattgatttttcatctctctatgaagcatgaccatgttacttattatgtgttacaggcagaaatgtaattgtagatgttctctgcagttgctgaattttcttcaagaatataacacacacatgcagaagactgaggaagaataagaaaaacaaattgttggcatcaggcttagctttatgattaacctattgcatcactgtctgaggtagtaatagttcatgcagaaatccagcaaagaaggaagagagcatgagcccagagagggttcccattagaggactaatggatgaggggaatgtaagtgccatgcagcattaggggcccaagtggggtcagcatcatagtgattaagaagttaaagtgagctcagttggtgtatttgtgcaagagcagctgtagggttggaattttctgggttggggtgtagctgagcacgttgatagagggagagttgggcagggcatagacgcagggatggggttatgatgactggttgtggaatttcagactgagttacccgagcacatgggggtggggcgttgggcagtgaaaagggctccattcaatgggtgtcaggtccggatagactcctgagctgtagtactgaagtaagtgacctacaacggcagggaggtagtggctgtatgttgggaagatagaggaacagctgagtgcagtggtcaaggaccaggactctggaaccacccaacttgggatccaactccagtttgaccattgctagctcagaaaccatgggcaaagtatttatctctgtgtctcagtttccttatctataaaaggagacatggtaagagtacctacctcagagctgtttggaggattaaagggttcctatgcaatgggtttatttaacatcttcgggatgcaatctgaccgatggttgctctttatcattgctattattaatgttacttagatgttgtagtcattgggaatgacaaaatctaggggatgactgtgtgagtgagtgtcacatagaggagagaaaacactgttattggagattaggtcaaagtgtagaaaagccagcattattgggaggttcatctatgtgcatattgaaatgaccaagattttacacatgtttaaaatcttagtaagaaagaatgtttcttagttaatttctgtatagatcttacctatctgtggtaaacaaattataggcagggtcatcaattactcttcatctgaaatcaagaattaggacatacgtgttgaatatgtataagaaaggaaatgctttactcaatgactgatgaaaaaagttattacattgttttagcgtatgagtggtgaacataattgtttaaaactggtcataaacgttgccgaaaagaaaatgttcagaagtattgattttaaagagtattcttttagagctaatgcagaattatgctttgtaagtattaacatttaccccatttcttttcacttttttgttttgtgcttctagaaaatatttagagagcaacaaaagagatggcaacaagagagagtcgttagcagacagcaactgaaagagattaagctgctacatgagcaattcatgaaggtctgttctatttggttatacaatacattcttatgaaatacaaagcgtgcataaaaatagaagacaatctgcttgtttctgaatgcatggaaagatattttggttatacattttaaattacttaccattttcactttggatgtattgttctggatttaacataattggtaaatgtatttttaggattcatgaatagttttgtgggagctattgagaacaggaaaaggtaaattggaaattttacctagaaatacgcatcttgtgtataaagtcgacactttattaacacattaattaagattttattttcagtttttaggagatcagcgacaaatctatagtggaaagcaggaagtccataaatcctttctgggtgtcttttttgcttgtcttgtttcaacagttttagttaaacaggaagtaggcaagtataactactgagtatctcttttatttcctgctgtaatataggagtgttttatggcatatttactctcaaaattattactggctagtaatggttttacatgacaatttgtaatcaaaagagatggttcagatgtataacagaatgggaaagcctgcagattattaacactttgtgcattgagaattaactgctgtcatacagcacattagcgaattgtcatcggacaatgacctcttcttgctctagatgtatattatttaggaaaccatggaattcttttttgggaggtattctttttaataaccttgtgaaaatatacgttcgtaagtcactcttctggactaacttagatgtgttaaataaactgggaaaagagtttgataataaaattttcaagcaacttgaggattatctatacacaaaactgttatttaaatagaagtcacaagcagagagcatgttgctatgtttcccagaaaccatttattaattgatatgaacatgagactagaaaagttttcctgtcaatgcttatgctatatgttaccacttagacggtaggaactttggtatcatcttgggctcttaccggtctgttatctttcccgtgcagttgtcacgaggccctgcaagttttacctctgcaatggtcctttaatttctttctttaaattcccactgcagctgccctagttcaagacctcattcttccttgcttgtactactaagctgttatctgagttctctcttctcttctgagccatccttcattgatcggcaatattatcttcctaaaacccttcccttccctttctaaaatgcttcctagctcttccctcttcccagtctgacagtggtgtctacttctcatacttctcagttcttaggtattcagagacactcccctttacgtgaccccttcttaggcttgccttctgtctttcctcccatctctccaggttgacagccttctctgaatgaactcaccgttactcccatgctttgctcttgctcttccctcaccatgcttctaaaatctttttgttctttttttgaccgattgaaatctttagcaaactaagtcgacatcagcccctatttttggctacatgtcctagtgagttgtccttccatggcagttacacaatttttgtattacttttttttattcgtgcatttgctcatgccacaggaatatggaagagattgtgtattcgctttttacttcttcctcagcattaacatacaacattttagggagtaggaactgttgaactatttgttgagtgaatagggtgtatttcaaatatagttatgttttctctaccttgatgaagtcatatcacagaccattttatcccttcaatggaaaccatgttatatggactattagtgataataaatggatcactacctggtgaaaaaatgtggtatttcatgacgtaagactgccagtctttttctgtctttgctccacttcgaccttaagatggtcatcaacccatttttttcaggcaaagtacatgactgttgtacctgctgtaataatatttcactgaaatctggcattaaaaagcttaagtgggcatttggagctccatgtattgattacagtttttaaatttgaagtaaataaacagcatcctttattacaaaccgtttccttttgacatttaatttaccctgtttacaacgtgaaatgtaaagtggcggcctgtcagtaaactaggctttttgttttagagcatcgaggattcggaagagtattatgaaacaactctttttgatgaagaaagtcaacttaaaaaataaatcgccgtgttccaaaataaaattgtgtcggagactgtaagtagtacatatttaatctgaaaaactcaggattgatgtaagcactggaatactgtatttgtaggaatatgtatcagaattccttaaatttcttttttttgaaacaactgcagcaagagttggcacttattcagttgtctcttcaacctctgttgttctgatgactgaagaaataacttgaacccatgttatatgatacaagcataactccagctacactaaaccacactgacagtgttttgataattcttgtacaaaccagtatacctcatttatcattaattggtttgttaagtgcaaaacctcgtttctgtggaatgaaccctaaacacagttatgtgagtagcagcaattgttcagttatataatggttaattaagttgtaacattaaagataatatacttttaggtgtggcctctgtgggtctgtatcagtctcaaaatgtggaaagcacgggcatggaagggtacatttttctcttttacggacaacaataaaagaagactatattatctgtgcattcttttgtatttactcattagcttaaacagcacattccaataaaagtatgatttaaaaatactctgtagccttatcaaaattactaaagtaagttaaagtctgtgttcttgaaaaactttactacaaatgattaagacaactgaacaagatatatgtttatcagtgctgagccactggtttgtggatatgtcatttccacaaagacatcaaaatgccatttaatttgttttggttcaccattcaatgatacctcccctgagcattgattgaaagtattttattaacatgtatgtatacttaattacttatgattacaagtatttctcatctgtggcaagataaattatgtagagtgctttgtctttcaagtttaatattcatggagtacatggaagtttaggtatacatggatctgaaaacttgaatcatcaatttgtctacctgtctttttgcaatgtgcaatttttacatgtaacaacatacaaaatcttcatttggaaacattttatatagtaagtatgaaattcagaataattttggagtaagtcagttaaacgtattcttttgcagagtttctgaaattgtgttcatgaatcattcaaaaccccatactcccattgggaggagaggagccacttcctctgatttttctttgtgattttcattttaattggccctgctataccacttttatcttttcaaggtttcccaagttttaaaaaaccaagttcatacagattctgtttttctacattatgaggggcatttaattcctaaagttgcagtttttgccctgaaaagttattaggggtgtgtgtatgtgtgtgtataatgtgtatatttacatatgtgtgtgtgtgtaaatagacatgaatttacacacacacatacacacacatatatatttagttttatatcacttatataggaaaaatgagtcctctgtcatgatccaatattggacattatgaggttcatttaattcctaaagtgcattttggtaaaggatttttcttttatccaaagcgtgtattgatatataagtactacatcaagtttctaagaagatcattatttgagaactttttcagtagtcacagaggcaaaataagcactccagaggtccttgtgagacttctgatattcatactgagctatgtaaatatttattctacagtggaaggacaagagttaggacacagtgtacttaatgatggaatggttgatatttatgccaccccttgctacctcagatgagtaactgcatacttgaagtcactttggcagatattctgaaaggaagaagtttttgctctgaaaagttattagggatgtgtgtaagtttgtgtataatatgtatatatacatatatacgtgtgtgtgtttgtaaatagacatgtgcgtgcacatacacacacactcacacatatatatgactttagtttttagaataattttcagtttacaacaaattgatctgaaagtcctgagatttcccatttgcccctgttctcccacaatggcattccccactgtcaatatcccccaccagagtggtacctttgttacccatcatgaacttacactgacacatcattatcaccccaagtccgtagattacttcaggattccctcttggttaccactttttagtgactatttttctcatgtcacctgtgcgtagccagtactttatttttcataaagagaacatttaatttatacttttttgtgaccatgaaattttaagtcagaatatcagaaacaagtcacaataaaacaaatgtaaaaatttacttctctcccagaaatggtaagtcaaataccttttactaaatacatattcttgaaaattgcagttagctcttttatagtctagttgatagattgaagcacatagtttcctttagttccataataaacacctcctttgaaaaatggctgacatcaagaacattatgtctcctaagattgtctcactcaacaactgaattattgaaatgtacaatcacaaaaatctaagtatgtctttataacaacgatgcactgaacaaaatttagaggtaacgggcaaagttagcttccaagaaaatgtgcccacaaaccagtggcaaatcgtttccttcagcaactgaaacccagaataaatgcagtctgttgcctctgcctgttggagaggggtcttcttacacctgagggaagtggccatctcgtctccctgatgttagttaaaattccatctgggattggcaggttagtatttttgtgcagatatctaaagaaagctgatctggccaaatcaaaaaatacttgactcactccttaggaggaccttaactctgccctgatttctgtgcacacaccagatttattgcactcacagtacaaaagctctgaggtgtaaaattaaccaagcagtgcattgcattcttatccagatgaatcggggctctctcagtgctgctcaaccaaagcacattggaatcacttcttcttattcttatttgtaaaactgacagtgatgatggtatctgtgtcgtgggaatattgtgagtgtcagaggaaacaatgatggtgaaaagcttagacagatcatacatgtcaaataaaagttagctgttaattactgatattgtcatgatttttactgctatgtaatagttgtaaatatatatggggtaagtgtgacattttgatacatgaatacactgtgtaaagatccaatcagggtagttgggatatttagcacctcaaacttttatcatttctacctgttgagaatattgcaaatcttccaagtattttcaaatatgtgataattctggttaactatagtcactctaccgtgctattgaagactaggactcatttcctctgtctaactgtatgtttgtatctgttgtccaacgttccttcctccctgtctttcctggtaaccacctctggtaaccaccattctattcactacctctataagatcagttttttttagctctgacatatgagtgagaacacgtgacatgtgtcttcctgtgcccggcttatttcactaaacgtagtgttttccagttgcattcatgttgctgcaaatgacaggatgtcattctttttatggctcaataatattccattgtgatatatagtgcatttcttttatccattcatctgtcgatgatcacaggttattgggggacctcacccccaatatttcaacataggttctttctattttccataagtgtcggctggctgagaaataaagagagagagtacaaagagaggaattttacagctgggcctctgggggtgacatcacatatcggtaggactgtgatgcccacctgagccttaaagccagcaagttttcgtaaggttttcaaaaggggagggggtgcaagaacagggagcaggtcacaagatcacatgcttcaaagggcaaaaaggagaacaaagatcacatgcttctgaggaaacaggacaaggacaaaacagaactactgataagggtctatgttcagctctgcacgtattgtcttgataaacatcttaaacaacagaaaatagggttcgagagcagagaaccggtctgaccttaaatttaccagggtggggtttcccaatcctagtaagcctgagggtactgcaggagaccagggcgtatttcagtccttatctcaacctcataagacagacactcccagagtggccgtttatagacctcccaccaggaatgcattcttttcccagggccttaactattaatattcctggctaggaaaagaatttagtgatatcttccctacttgcacgtccatttataggctctctgcaagaagaaaaatatggctctattctgcccgaccccacaggcagtcagaccttatggttgtcttcccttgttccctgaaaatcgctgttactctattctttttcaaggagcactgatttcatattgttcaaacacatacattttacaatcaatttgtacagttaacacaatcatcacagtggtcctgaggtgatgtacatcctcatcttatgaacataacaggattaagagattaaagtaagacaggcataagaaattataaaagtattaattttgggaactgatacatgtccatattaaaatgaaatcttcaaaatttacgttcagagattgaagtaaagacaggcttaagaaattataagagtattattacggaagtgataaatgtccatgttaaaatgaaatcttcacaatttatgttcctctgccgtggctccagctggtccctccgttcggggtccctgacttcccgcaacaacaggtcgatggcatcatttggctattgtgaatggtgctatgataaacatgggagtgtagatacctcttcgacatacttattcctttctctgagatatatatatgcaaccgtggggttgctggtccatatgatacttctagttttagtttattgaggaacatctatttccatgatggctgtagtactctgtgttcccaccaatagtgtaagagctcttccctttctctccatcctcatcagcatctgttatcttcaacctgtttgataagagctattctacccagggtgagatgatacctcattgtggttttaattggatttgcctgatgattgatgatgttgagcattttttcatataccggttgctcatttgtatgtcttcttttgagaaatgtctattctgatcttttgtccattttacaatcagattattatgactattattttgctattgagttgtttgagttcattatatattctggttattaatctctagttggatgtatagtttgcaaatattttcttcagttctttaggttgtctcttcgttgattgtttcttttactgtgcagaagcttttgagctccatgtgactccatttgtctactttgcttttgctgcctgtgctttggacggcttactcaaaaaatctttgcccagaccagtgtcctcaagcatttccccacagttttcttctagtagctttttagtttctggtgataaactatgagcatgcaggtgtgactccatttgccagtgtggtggactgaagttgtgaggacagaacggtttgtattttcataagttttcttatgcaaagttgatttgatgacagtggcctacaataaaaacactccttaatgtggcagtcttcagtaccatataaaatgtgcaaattagcaacatttctgtctgagtttggagctacaagattcaagtgtggagtattatattgttcccttccctttaatatttaatggaggaggtacatttttgcctgtaaagagatcaactcatgtatctaattatgtattaggaatatggggtcatttccttctatgtggtaatatattcacatatgggggaaatgccataatatatgggacaacaagatggataatattgtattaatgattataataaaatgaataatgtaatatgaagaaaaaaatcaattcactttaaatacaggctagatactttttaataaaatcagtagtgcatattgttcttttgaatctttcagtggtgcttaaattaaatataaatttgaacactcagatttaccctataatccaacattgttgctcctcaaaatgaagacttcacaaaagtgatcattgaggaaccagaatttcagctacatccggtctaaagaagtagggcaatcagtagctaaggggtttgtcaatcacatttctgaatggggaggatagctgatgctgtatgaagcacagatgatgcagacttatctacaggcttcatgcatctccaccttcagttccatgatgaaatcactgtctggctatactgttaagtggacagtgctacagagcaacatacgctcacaccactgcgagatcaacattagcacacggacagggcaggaaagagctttccggtggcatctatcacatttctaatacagaccatcactgaggtgacagaaactgttactctctatgtgcttccgtaaggcttgaataattgttacacaatctcggattgtgtctcaaaaaaaaaaaaaaaaacttgttgtatagacgggtttcactatattgcccaggcttgtcttgaactcctggcctcaagcaatcctactgcctcatcctactaaagtgctgggattacaagcatgagccaccaccatgcatggcaaagagtcacataatttaataaacacacatacagtgattgtaccagggtggaagttgcaaaggctctggagatgctgattagaaggtttgcaaagacccattctacttgtcaaagcaaatgaccccagaagtgaaggggtggagaaatagactctccttttgggtgaaagacctgcaaagaatctgaggacatttttaatccacttcagggaattaaaaatcgcttacacccctgcccagcccaatcccctcagaagcctggacaaaactgatggcttttgacgagaggaccttgtcatcttccaggacctcaaagtcaccaccctaaaatgggatttcccaagtgcactttccaaagtgaaagagcagaaagaaatacaacacaatagacacctgcagttgtaacaaatgaaagaacagcttaaatggtccctgcaatcttcacatccttttgcaattcccttcccttgtatgtgggctggtcccagagacctggagacttgattctaatgcacggaatacagaaaagttggagggatgctgcttctgagattaggttactggtttgctcactctcacttcctcatttgctcatctgattgaagccagatgccattttataagctgttctgaaaagaatcccatgggtcaatgatctgagagaagtccctagtgaacagcctacaagatgcttagtcctgccagtaaccaggtgagtgagtttggaatcaagtcctcccccagccacacgttcagatgagactgcagccacagccactactttcagtgcagcctcatgagacactgctaaccagaggcacccaactaagccacattcagattcctaacccaaagaaactgtagaacaaggttagattgtactaaagccacagaattttagggtatctgttatgcagctgtaaacaactattaataaaacagatgggaaaaaatacagcaggcaataagaaccaaaggaagaggagacggctctataaaatgcagaaagtttatattgagtcaaaataattgtcatggataaaaatgtatataaaatgattaaagttactacttataagaatgatatgacatttctaagctcatttgtgcttaataaaacacacctaaaattcataaaccaagaaaattcaaaactacagacagaaattaatatatatatataaaatcatagtgtgagtttttaacattcctctctcaattttcaacaaatcaaataaataaaatatcaaatgttgaaattattttaaaaatgaaattaaagcatgtttcattaactagatcaatgctgccacttattagagaaagtaagctcatatggggcatagaccacgacaggccatgtgctaggtctgggaaattgcagagagttgctatcataaggatcattttttcaaaccacaaaaatattttaagcttataacaatattcaaacatttaacaatatacctattaataatagcttacaagtcaaaaagaattcattagggaaatcaaaacatttcaaagtaaatgctaaaaatactacacaaaatattaacataatccagaaaaagcagctcggagagaaaaatttaagctttaaatgcataatctggaaaataaggaaacttacacactaatgatctcagtgtccaattaagtagttataagaggtacagaagaatatttccaaacaaaacagagatgaggatatattatgatgacaatagaagttacaaaaaacagacattgaataggaacattaaaagaagagtggatctttaaaagtactaatagaatagtgttcctctatgtggatatgttctagaatttcaaactgactttgaagaactcaccagaagtgaataggacacagccacaaatggatataactgcatttagaaaacggcaaagaccatggaagacatacagcaagcacagtaacagtttaaggaagggaaggagagagagggacgacctttctatgagggagcaggatagaggtgtgccctgaatttgaaggacaagaaggaatgagatatgcagagatctagggaaaggagttgtgaggtggggtgggtgtggagtaacagagagtcccaggcctgtcctcctggacggccagtggagtcatgcgccattggcagagaccagaggcaaagagaatgatgctgtgtggatgctgggaagcctatgggtcttccctccggattgtggatcccttgagaaaagcagggaaaaaaagcagaaaaaaaaatcttaattttctctaagatacacacacacacatacacacacacacacgtatacatgtaaacagttgtttaaaaacaaggatactacagtgcttaaaattaaaaattaaaattgcgacccttcttatccacttttgattcttgctccccagatgcaaggacctttttttgatatttaactccatattttaaaatcaaatgctttcatccaatcacttgaatttttaggtttagatcttatcttttgaagatgattcagcttatgaatgtgactcatcacacatacactcacacactcgcacacacttgcacactcaaatacactcacagactgtctcacacacatctgctcacacacacacttgcactgtcacacaaactccacacatttgagacactagcattcacacactcacattctctcacacacacactcttacacacattcacacactcacattctctcacacacactcttacacacattgacacactcacactcacactggcttcacctttccccaacttagttacatcttattttgtggcagatgattattacatatttatagcatcatgattatgtaaatagtgctcttggctagaacacacaatgcactataattacatttcctttaatgaactttgttttcttcagcagtaatcatcttgttgaaatcattttttttttgcccgtttttaatgtgcttaggactggtatatcttgcaactcccctgcagatgcacacttccccgtcaatgggtgtccccttgtctgataatttctttcttgcgtgttcatgggcgccactctgggatccttcgtcttcaggctcagtttgagcacggtgctctctgggctgcttcactgctggtgtcatcgccatcctggacggcctcttcctttccttcctgggtgaagtcactgtttcttggagctacttggtttatagatgtgttttgttaaatcatatactagagtactctcccccaaaaaggtgaatgggtaatacctgcttcaagtcgacatgcatgtatgaaaatgcctttattcttccctcctacatgaacaaaagttgggctgagtagaaaatgctatgtgagagatcttttcctctagacatttgaaggcattatctatctcctagctttcaaggttgctgttgagaagtttgacagcatttagattccccaacactttgaatgaacctgatttttcccactgaaaaatgatctcctacttgcctcattaaagtttagtaatgatggggctggtttgggtctttataatcaattgtactgaagagtctgcagaccccttcaattaatttattaaacacaaaggtatctaagttttaccatgcgtcaaacattttctgggtcctgggatgcagacagagcagtgttcttgagcatcttaccctctagcagggaggcagaaaatagacaataaacatcatgcataaccaaatggctttgtgatatgttttatgaaattaaagaaaaagtaaatgagaatgcgagagacaggggtagtgggtgggtggttgcaacatgaaatgatgatgtgagggggtgaggaagccaagagttggaaatctcatcctgggaggaatgaagagccatgcaaaggctctcaatcagcccctcatgctgccataacaaagtcccacagaccagggacttaaacagtaaacatttattcctagcctttctggaggctggaagggccagtgtcaaggccccgtagggtttgttttctggtgagtgcctgcttcctggcttgtgggtggccaccatctcactgtgtccttgcacagtggagagcgagggacagccaggtctcagtgttcatccttaccagggcattgatgccatcctgaggctctgccctctgagcttgactaagcttaagttaatcacctccaaacgcttcatctccagatacccttccattagggatgagggcttccacagatggattttggggtacacttttcagtccacagcaggctctgaggtaagcatgttcctggcatgttgaagaaacatcagggaattagagtggcaggagtagactgacagctagggagagtcgtaggtgatgaggcagacagatcacaaggcccttatccatttctggggtggggatggggtgctttggcttttcatctgagtcatggagggacccaagcaggcctctcggcagagcggtgatgatgagttaacacagctttacagtcttactctcactccagagttaaggacggcctgtatgagtgtagaagcaggaaggcctgttgggaatatccgtagcagtgtacacgagagatgaggtgggtactctcggtacagcagcagcaatgaaggagagaaacggtcacattctgaatacctcctgaagggagagccagtgggacttcctgttatattggaggtggaaagagaaaagaaaaagaggagtttaagatgattgcaaatttttggtttgagcaactaaaaggaaagacctagcattgctgagatgagaaaggctgtggtgaagtggaatttggggggatggtgaggcatctaattttatacattttgagtctgagatgacagacatccagaggatgtgacaagtgcagctggacagattagtctgggattaggaggaaagttctaatctgcagacatagagtcctcaaagtagggatgatcttcaagacctcaccctggatgagagccacggagacagtgagtttggacctcagggagaatgtcccatattcaggcactcagcatttaaagctcaaagagaagaagaagggccagaacaggaggctgagaaagagcaatcagtgaggcgggagggagaagccaaaacaagcaagaaggagtgaggtcgggaagccatgcgaacacagcacatgcaggctctgctgtgagagcaaaccacatggcacctgagaactggccactggtctagcaatatgaaagttactggtgactggatgcctcactgatgtcagtttagaagagaatgagggacaagcaacagataatcatctttgttgcaaaacagtaaaaaatatgtagtagttggtgggaaaagtggggtcaagagaaaactggacaggtcttattttttcttcttcttcttttttttaaatgacctctcctgttctccatttctttgtgctcttagtttctgaaagtttccctcagaattttattgaacccatctaatgaaggtaggtgttctaccttggcttccagaatctccccagcaggtcaggttcaagttgcccctggtggtaactggcttgatgatacacccattcctggtgccttcttctccctgtctcacttgcccacgtcgctgtaggtgttcccttcaccttttgaataagctagttgcacttgaaccctctccttgatgaggctccaaaccaagacagtctgctaagtcacttttgcttagtctttccttccccatttccaaaattgtgttgtccctgtctgttccctttgttgtgtgggcttaggccttttgaaaagtccttttactatgactataattaggctttgagaagagaaagagctaagtgagtgtgtcaaatttgccatctttagccaggagacatttctcaatcatcatgatatcagcgacctcatcaaggagaaagaaacacagttctgacctgtcatctgtgattctgcaaagtttactggagtctaaaagttggtctccatgccaaagttagctttgcccaggtatgacagtatttcatctttgcaggccgtaaataagccgtgagcacttaccgtcagtgtgggaagtggacggatacttgaggctgccgaaaccccactgccagcccgttcatccttggaccgtgaagccaccctcattagcactaaatgcaacattgccatcaaggtcactcgtagacacttgagtttctttatcacctgcacaacaccaagcaaaatgaaaagaccatcttctcaaatcaggatctggtgaggctggtgttgccctgatggttacattagaacggactgaattgttttcattaaaatgcaaccccattactatagatgagaaaggaactccaccgagggagatttcagatctatgttttgtttcactgaattatggaaaattaacatgcttctgtcttcactcctaaaggtaataacactctctcaatgggaggcatggagcgcatatgattaggcagcctggaggagtgaggcatgtgtctaattttgctctcaacaacaacaacagcaacaaaaatacctgttcattaaaagcagagaagagatatttatatatcaaattagttcttttgatttaatccctggagtaaaatgtcataaacaggtattaatttgggtctgtttactaaaaatttaatgcctgcagaaaatctatttgaatcatcacaaatgtaatattgtctaccaagatgaaagtggggaattatagcagcaatttgggatgaaacttgagtgtactggagctggtgtgtgcccaagcacagactaattaatgtctgtgtgctgcccaactcgcagattcacactcagcagagcatcaattagaggggtcaacctaatccacatgccttactaaagcaataaaatcacttcttccatttctaaatattattgctgctaatatgtggcccttaaatgtgtgttcttagctctcttgatgaaagggattaattatcaggatgattatttcatcatatgattttgttgctctgcctgataaaacaaaagacatttcctgggacaagaggagggatagctaataaagtcattctgtgtaaacaccgcagcactgaaaccaacaaacggttgtgtccatggtaatgatgtccccagagaatggcattgtggggagtatggggacctttgatccaggctccttagccaagcaaaagagaggaaaggaattttgttttttcagatcattcaaaggcaattccagaccccccctattgctcctgtgcttgcaatatttattttctttgagtattccaggtattacagtgtttgggtcaaaagaccagagaaaatggccttaattttgtgtttctttcagctaactagcttgtaagtgttaatttcaagggtttgtgaagtatctgggatacctaaagtctctctgcatacctggcctcccatttctgccacagccctgcaggggaaatcagggcatctctatgttaccaatgaaaacattcacatgcagaaatagtaattggttctctaaggccagagagttggaaatgtttagccaggacttgaacagagctccaccccattttcaatcctgttttcttttaactgtactaagttgtctcagtctacctaaaacacctatctgaggaacaacatccttcagagtccagggaattggggccatggcttcaggctgtggtcagcccttatctaggggaatcttgcctggtggcttagagacaaagctgctgccccagcccatgggcagtagggtggctcactgaacagggcatcagtagcttcctgtccacatacaactggggaagagtgagctttgttcctcttgaggctgagggccagaggccttggaatgaaaccagggtctcagatttcaaatccacctttgtccactgggccccttcctgagcaagcctctcagtgtccaggggtccttgggaagctctgtgctgtgcccagggcagctggctggctgtgtggcctgttgtcttgttggactttttccaggaagaggatcatgttcccatcccttcacctgaaactgcccagtggagctcagccccatccctctctctgagattggagtgtgtcagggatttttttttcctttcttgtttcctttctgttgtttctagagacacagattcttttctactgggctgggagccattcctctaaccctgacgtttagcctgaagcctttgctttctccttctcagagtagtcctttgaaggccagcctgctttcatctgtgtgcaccatgctcagatgggcttaaacaaccccctacagtctcagaaatttcaagattttctgctcagtttgggctgcacagaaaccaaagaccagtttggactatctactcccaaggaagattgctcattgctgacataaaaccaagagatttttatcagaattcaatgccagctaggcatagcttagcttcgtaatatgaatatgaaaaaagaaattttaagataatttatgatagagccggtacagtgattctaagattcattagttgtcatggtacccctccacactcacatgcacatacatacaatcataccctcaacttgggcgctctaaatatggaaagttcattgtaggaggttcctgggtggggagaccaagctccaagatgacaagctcaatggcagaataaatcattgtgcctcagtcttcacctccaagtcatagcatttaataccatgactgatagatggcaagaacacaacaactgatgaatcaaaaaatgaatggacaattaaaagaacaaaatagaagcagaagaaggcagcatatctgctgctttagaccttcatgatgttggccaaattcagccacttcgtttccttcataggatctcatggtgatgctgtgaatcctctctaaccaaagcccttctagtcagatatcttaaatttattgtcaataatacctttcatttacttacacaaaagcttctataatgtgggtccaactgttgagctgttgtgctaggcctgaaataaatatgtaacaactcttatattttgaagttgtctttaatttggcactggaatctcaattgcagcacaattgctgtgacttcagagctgtgcatctccttttgcaaaaacacataaataattaaagaaaaccgaaagaaagaaacaagaagccagcactcacatcttggtggtgcattgaagcccacatgtaggagctcaggagagccaatgataaggtcagtgatgcttcgatggtcactcaagatcagccatggcaggggtatttacaccaggggaatgggacagaggagagtgggtaagctagcacagcttcccagatcccacctgacttctcccttcccttctctgcaggatctgcactcctcaatagacacatggtctgcagcagttgttcccaacctttttggcaccagggactggtttcatgaaagatggacaggggtggggaggatggattttttttttccccattgactgggggtgggatggttttgggatgattcaagaacattacatttattgtgcactttatttctagtattattatgttgtaacatataatgaaataattatacaactcaccctaatgtagaatcagcgggagcctggaacttgatttcctgaaactagattgtcctatctgggaatgatgggagatagtgatagaccatcaggcactagattctcatgaggagtgcacaacccagatccctggcatgtggagttcacaacagggtgtgtgctcctatgagaatccaatgccacctctgatctaacaggagatgcagctcaggcaataatgtgagtgatggggagtggctgtgagtacagatgaagcttcgcttgcccaccactcacctcctgctgtgtggcccagttttgggattggggacccttggtctatagaatgcctggctcaggtagacacgatgccatgcttcctattgtgcacgttgcttttggtcagcagtgcaggcagagaaatgcaggctgcaatggttgtttatagtagcagaacacaacagtctgctttctgttttggaatcagggtcttgggctcagctcatgcactggtgtactgactcctgtttttgtttgtttttttgtttgtttttgagacggagtttcactcttgttgcccaggctggagtgcaatgacatgatctcggctcactgcaacctccacctcctgggttcaagtgattctcctgcctcagcctcccgagtagctgggattataggcatgtgcaaccacgcccagctaattttgtatttttagtagagaccaggtttctccatgttggtcaggctactctcgagctcctgacctcaggtgatccgcccgccttggcctcccaaagtgctgggattacaggcttgagccaccacactcggcctcctatttttaattaaaagggtaaattcagagagaacatcagtgaattggaataaatgtgttcatttctctctagacagaaggtccctgtgagtcatggtgcactgagctggacaacaaaacctcgcccccagtgttccagggggccatgtggatgggagtaggaacaaggcctggggaccccattccttgagctcaactcttgaccttaccatcatcacagcaagtttctgaaactttctgcacctcagtttcttcacctttactgcggatgtccaggtagcacctaagagatgagtttgtcttgagtgttaagggaggagatacacctgaagctcttggtaccgtgcctggattgcaaatgtgcttccttaatgatgtcagcagttgttgttatttttctttgccattacaatgttataccaatcctatgggatgttattgttttaaaactgcctgtgagtattataaacaatatcaacaacaaaaccaagaaaaatgccgctctctacttcccctgtggaaaaccacaatggccgtaagtgtctgaacagttgaaaaacctttcagcagtgagactggttaactttaactcaagagttttgcaaacatacttgaataggcacctatcagctgctggggctgggaagtatggttgcacccaccttactgtggttggctcagcttggaggagccctgggagacctgcagagagtgtgggtgctagagccttctgcagggctcaggacacattccccgacacacccagggccaataatttgcactgggatacagagaggaggctcggggcctctgtcaacagattgccatccacttagatgagtaaatgggtaagaacctcctcgggccttcctgggagacccggatgtgtgaggaccgttctgggcccttgacccctggtgtgtctccacagtgctggccccgtggtgtggtgacatctgtctgtctgtctggtctagcatccagcacagtcctgggcacatgaattggtgctgatgctgctgaaggagtgaatgcaggccagaaggaaggagtgctggggaagaagtgagccatggagcaggtgggtcagggggcagggcagtttacctgaccaagctcgggggagaaggcagcttcagagacaggctggagggagggtggaaggaggagagtccttgtgcgaatggtggtcgcagatagcatggaggcttgccccctgcaaagccacccttgggcacaaagaccagggagagagaggaatgcaggaatggggagtgaggggctgctgagatccaaggacctggctttctgcctcagaagcttggtgtgcagctgggaggggccgagtgcagaaatgctcctctgtaaggatcaggactttagcagatgccagcaaatccatttgcacccagagtaggagtgcagagggaggcgatgtggtcagaggtgaaggagagagagcaaggagcctgatcaggaatgagggggcgtggtcaggagtgagggggcatggccagtgtgcggtgagtgagggggcgtggtcaggggtatcaagagcgaggggtgtggtcaatgatgaaggagtgaggtggtgtggtcagggatgaggagagtgagggggtgtggtcaggaatgaggcgagaatgaggcatagtcaagaatgagagtgagggggagtggtcaggagtgatgaaagatgggggtgtggtcaggggtgaggagagtgagggggtgtggtcaggaatgaggcgagaatgaggcatagtcaagaatgagagtgacggggagtggtcaggagtgatgagagggagggggtgtggccaggggtgtgggtccaaaatgaggaaaaggaaaaaccaaataccagaagaaaagttggacccagaaatcgcttttttacaacaagcagccgttctcggaattttgctcagtgcgtctgtattcagggagcgagaccctgggggaagcctgtgcaggagacagagggcagccccacctcattcttctgctggtcactctgtgctcaggcaggaaccacggacagaggcctcccagttcactcggggacatatccgcagatgtgagaactcagagagatgttcaagtttcctaagagggcttcaatcatggctcacaggtgacacaggagaaatccaagtgggcttctcaatttgttaaacttgtttttcctcctcatatgctttataaacaaaaatggaagaatttaatatatgtacagagcagcaaatgttctctccctgttgctttcagatgttttcctcttatgtaaacagtgttgatgaaaatataaataccatcattccaccttcatgttaacaatcttattatcttgcatcaacagaagtgaacaaatatgtacatgacacctatcaattcctttttaaaaaacgtatttctaaagagtggaggaagaatttaatgaattcaacatgtagtttacctgcttatattttgaaggcgatttaatcaagtaaaaccaaattattgcttaagttgtgtcagatgtacaacagccatcaacactctccatgctaatgcggggtaaggggtgggtggaactaatggcaatgggtccaagtcctctgggtcaggcgattaggggcttcgcaggctggagagaatgtttagatgctggggcaggatatttcaacctgctggtcaggtaagagatatttgctggcagtgaaaggaatattttttgtggaacaaattgctaggaagaggtcacttggggggcattagatgagagaaatatcaaagccaaaccccaaatcagtctaagggagctaaggaaaacggaaatcactactgattccatctcctcattggtttcgcttattccatagcatactttctttttccatcttccatcacttcatattcttttctcctccattcttcggggttttttttcttctacctctttgtaacaaagaagcatttaggaacaattttaggagacagtgagacaaaaaaataatttagagaagacatgataatatactctgtgtgtgtgtgtgcgtaaaacatattaatatatttgatttgccaagaaagataaactgggatttttgagatttaaaaaattcatcatggccaggcgcagttgctcatatctgtaatcccagcactttgggagtccacagtgggtggatcgcttgaggccaggagttcgagaccagcctaggcaacatggtgaaaacctatctctactaaaaatacaaaaattagccaggcatggtggcgcacacctgtagtcccagctactcgggaggcagaggcacgagaaatgctggaacccaggaggtggagattgcagttagccaagatcacaccactgcactccagcctgggcagcagaatgagactctgtcttccaaaaaaaacaaacaaaaaagccatggtatgtctggttatattaatctccaaaccagctagtgtttagtattgctagagctataatagaatcaggaataggaaacaaataggaaaaaaaggaattttacaaggatttatatttgcaaagaaaaaaggacttatttagaattgtttgttgaaattcccccaagactattttttgaacttatatatgtagacaacaacaagaaaaggagcttaggagttctcacagggtttaggaactactagaccttgtgtattatgttcatctcagcactcaagcaagtaaaggataactagaacatggtatctcacagtgaataacatggttggttactttactaggctgacatatggagatagggcctataggagcagggcttttcttatgaataccagagagacacccaggttcaactgcatgtacagtgcatgagggattagctttacagtgttatctgcaaagtacctaaaagtgttctctaactaagcaccaacttcttagcctagtcctcttaggcacacacaaaaaaatatctaatactaagcttataggaatactttatttggtcacttggtgggggaaggttgctgagacatataacatttaatacctaaaggtaggaggaagcaaggaaagagaaaatgcagaaaggaagagtaagagcccaaagaagggtgccacctctgtagactctctaacagaattaaattgacaatcttaagataacagaagtaaaagggcatgccttgagggaagcatcaatacacttttggaatctgaggcaaaaagtgaaatgatttacctcttgccaagtctattgtcattgccccatgggaggttcccatttcttctactcttgaatgcacaagtaatattccttgcctaaggattagcatgctgtgataatggtggtaatgacagctgccttaaattagtggcaaattcagaatgaaacactgaccaccaggctatgtttctgaatccagtctatgccctcgaatgtattcaatctactttctgtggtatccccgagagctgtggcaaaagagttgtatggtaggggcaggctccttatgggggcataaatggcttcagaaaacaagtattccatcttctcaccatgactttttggctttcttttttttttctcttttctcccagactactaatttccagtttcttctctaccagtctggatgcccatggtgaactttagagatatccatcagctccatcaattccctcaactacatctacctagcttttgagcccagaagaacccaatcatgtgtgttctcctcagctcccaggctgctgagcaatgctggagaaaaatcacaaaactatacagtttggtatctctccagaattatggtttccagcttgagttgggaattcagaattacttcaaaatgtttaaatttgtttctggtcagtttcctccttcatttcccagtttcatttatcactctatttaacttgttacccatcgctgtctgctattaaccttgcctccttttacacgagaaaacagaggccatcaaatggcatttcccatcactccatcactccacctctgtcaatgaatccaccagtaacatctcagagatccttctgtctagcactgatgatcttattgtatcagttactccttcttccttttgtattttcaatgctcctattggccaccaacatgctttagctgttctcatctaaagaaacaataacaaccacaataaactaacaaacaataaaccatctttaacagaccttaccttttcctcttttgcgccaccttcaagcttcctaaactcagatttattcctcaatccattacaatctggtttctaattaaacaattttttgccagcatcaccaaaaacttctgaattgctagcctccaaggtcctttcttcaacctcattgttttctttcttttaaaagtcaagttcactgaagtataatttacgtacaataaaattcgcccttttaatactcttttaccatctaataagttttgccttgtatgttggttccctgagacctgtaaaacaactcccaaatcccaaacccctttgcttcatacacaaatccctttggaatgtctcagcagatataacacaggttcaagttctttcttcagtcatcagagtaacagaggttgaagatgcaatcaaataagtgccaactcttgctgctcctgtttcaaacaaggaaatttagataattgttatacacatttctgcaaataaaatattccagtgcttacatcaatccttagttgttaggattaaatattcactacttacagtttccaacacaatttttttttaaaacatggccatttcttttttttttttctttttttatctttttttgagacagattcttgctctgtcgcccaggctggagtgcaatgccacgatcttggctcactgcaacctccgtctcccaggttcaagcgattctctggcctcagcctcccgagtagctgggactataggcatgcaccgtcatgtccaactaatttttgtatttttagtagagacggggtttcaccatgttggccaggatggtctcgatctcttgaccttgtgatctgcccgccttggcctcccaaagtgttgggattacaggctgagccactgcacccagccactatttatttttgaagttcactttgttcatcaaaaagaagcctttcataattctcctccaagttcttgatactctaaaacaaaaagtatagttcacagataaaccaccacttttcatctcacgtttcaaacacagcaatttaaatttcaaaggaaacagcatttaacttggttatttattccacatttaaaattgtaataaatacatggagcttgaaatacccacttatttttcttttctttttttttttttttttttttttttgagaccgagtctcactctgtcaccaggctggagtgcagtggcacaatcttggttcactgcaaccttcacctcctggattcaagcgattctcctgcctcagcctcctgagtagctgggactacaggcgtgcaacaccacgcacatttacattttttaatgccagatttgagagaagtattatttagcaggtacaacagtcatgtactttgcttgaaaaaatgagttgaggaacagttaaagacaagatggagccattacaaaaaaagactggcagccctatatcatgaaatatcatatttttttcaccaagtagtgacccatttattgtcactcataactcaggtaacatgatttccactgatgggataaaatggtctctgatatgaactcatcaagttagagaaaacataacttacgtttgaaatgtatactattcattcaacaaatagttaaatagttcccactacctaaaatgttgtatgttaagtactgagaaagaagtaaaacatgaatacacaatctctttcatattcctgtgacatgagcaaaggcaggaataaaataatacaaaaatttataattggtatggaagtgcaactcactcgggcatgtaggcaaaaatggagattgatgctggcatagttggcaaaagaatcatatttcaatcagttcataaaaagatttaaaagcattgtgagggaagagcatgagcaaaacctggaggtaatgatgagttccttcagagaaggctatcaaccaagagaggtggaaggaaagacagaatggaacgaaacaagcctaaaagggggtcatgtaaaggggagtgtctctaactatctaagaatttagaagtggacaccacagacaggttgggaggagggaagggctaggttttaagaagataatattgccaatctataaaggatgactcagaggagaaaagagaactcagctaagagtttaatagtacaagcaacgaaagatgatgtgaactagggcagcagcagtgggaatttaaagaaggaaattaaaggaccacagcagaggtaaaaattgcagggcctaatgataactgcatgggaagcataatggacttggaatagtcaaagataataccaaagctcctaccctggtaacatgtagcaataacattgagaataaaacttttctattcaaatgttcacatcaattaataaatgttttgtgggaacattatagcaacatattctgtacttgtgagttctattgaaataactgtcttataaatatatatttcttaagtggcttaaaaattgtatgttcaaactcttttaccagtttatttaaatcatctaagttagtttggaagagtgacacataaacatgtattttcacaaggctattaaaaagaatacctcccccccaaaaaaagaatttcattggctcctaaatagtatatatctacatgaagaagaggtcattgtcagaggaaaaatcactcatgtgaaatacaacagcagataattatcaatgcacaaagtgttaataatctgctggctttctcattctgttatacctctgaaccatctcttatgattacaaattgttatccagataatgaaataatctgcacaaggaacccccatgatacaagtttaactatgtcacaaaactgcacttgtacccctgaacttaaacatttaaaaaattgtcatgtaaaaccatcactagtcactcataattttgaaagcaaatttgccatgaaacactcatatattacagcagaaaatgaaagagatattcaatagttacacttgcctacgtcctattgagccaaaactgttgaaacaagacaaggaaaagacatctagaaaggatttagggactttctgctttccactctagatttatcgctgatcttttaaaagctgattggtgaacgtaaaatgttaatatgtgatcaattttacacacaacatgtctatttctagatgaaatatccaatttacattttcctattctaaataattcccacaaaactgttaatgaatcctaaaaatacaaatacatttaccaattatggtaaatctggaacaataaattcaaaatggaaatgataattaaaccaaaatattttttcccataaactgggaagcaagaaacctgtcttctatttttatgtatgcattgtattttataagaatgtattatgttaccaaatataacagaccttttcgaattgctcatgtaacagttggattttttcagtttctctctctggacaaacctagcatgtagataagcctttagttgctcttgaagtattttctagaaatataaaacaaaaaatgacaaaaattggataaattttaatatttacaaaacataattctacacttttaaaggaatcctcttcaaatcaatacttcttaatcttttctgcttaacaacatctatgaccaattttaactcattatgttcactattcatatgccaaaacaatataattatccttttcttcagtcactaataaagaattttctttctcataaatattcaacacatatgtcctaattcttgatttcaaacttccagatgacctttcctaatatttgtttaccacagataggtagtatctatacaataatcctacctaacagaaattaagtgagaaatattctttcttactaatattttaaacatgtattacatctcgatcatttcactatgcacagaaattaatattccaataatgctggcctttctgctcttctgctccttgacctaatacccaacaacagcattctcccctcctctgcttgccactcacatagtcatcccctagattttctcattcccaataactgcaacatctacataatattattgatagcaatgataaacgggaaccataggtcagataggatcatgaaaattgttaataaactcattacataagagctctttaatcctcgaaaaaactctgatgtaggtattcttactatgtcccttttcaaagataagaaaactggagcacagagataatttgcccatggtttcagagctagccagggtcaaactggagttgtatccccagcagtgtggttccagagtccaggtccttgaccactgcactttgctgtttctccatctttccaacatacaaccactatctccctactcttgtaggagactcactttggtatacagctcagtggtctataaagacctaacacccatgaaatggaacactttttgtggctcagcaccacacccctatgtgctcactttcctcagtgccagcctaaattccatagccagtcatcataactccatccttgggtatattccctccccactgctccctcgtcacagtgctctgatacaccccagaggaggatattccaactctactctgctcttgcacaaatatgccaactgggctcactttaacttcaaaatcgccatgacactaacctcagtgggacctctaatgctacttggcaattatattcccctagtccgttaatgggaaccctctctgagctcatgttctctaccttctttgctttgaatttcagcatgaactcttactacttgaggtattgatacaatggattaattatcaagttaatcctgataccaacagctagtttttcttcttgtttctgagtcttcttcttcatgtctgtgttccagccttgaaacaacttccaaaactgcttaaaacatttgtaatgaagtttctgcctgcaacacataataaggaacatggtcatacttcataaggagatgaaaacttaattgaaagcaagacaaaattgatttcatagaattcgtagtacaaaataaggacataatagcagctgaaaacttctcattggaaaaggatgaagtttctctcattctaaaagcatttcttctgactactagagaagctgtctcacattctttatctcttaaaaccaaaggaagatggactatgctataaatttcccagaaacattcattttcactaaaagcagtttactttttatttcctcttagtagattcaatgaggatatcatagccattcatcccataagatctcccaaaagaaatatttcacttaactatttctacactttggcacaacaatgattttgtaaaaggaatagtgaaaaaatattaaactaaactatatatcttatttacaacataagattatccctttctacatcattgaatactgttaaggatcagaagactaaacatcaaagacatttaccatgtattcagctagcatatttctagaaattaatataaattaattttacaggaagactctactcttatatgaatggcaaaaagacgtcatcttccttggcttctaggtaatagatttcaattctgtcaaactgaggttataaaattaaagaaacttatgtgcttggagaaaaatcaagtaaaatatattcttcactggagactccaataattacaggatagtggttgtctgaaattatttgcagcaatgaatacaaagcaatgatacaaatatcacggttcaaaaaagccaacagccatactttgctctccgtgtgttttccaaacatgtttgatttttttgatagaagcatttgtattcatttcaaacttttttctctttgcaagaagagcctgtttaatgtcagtgagatagtaaacgaaaattaattaaaaggtaatgttgaaaagtagtttcttcacatatattcaaaacaatatgggatatgatgtttcagcaactttagaagaacattaaaaatttataatgcaagcatcatttcaaaaagcaagatttgctcacttaatttctgtgaaaacattcagatattggtactcctattctacacgatataactgaagatcacttttaattaatagatggaaacaaaggctaataatgaaaatagttgctatttttaaatgtgcataaagggttacaaacacaatcttttatttttaaatttataaattgtcctacaattcaaatgacatgtttatatgaaatattgtcacaacccattgcataaaacacacaaaagtaatttatttaggctgggtgtggtggctcatgcctgtaatgccagcactttgggaggccgaggcgggcggatcacgaggtcaggagatcgagaccatcctggataacacggtgaaaccccgtctctactaaaaatacaaaaaaattagccaggcgtggtggcgggcgcctgtagtcccagctactcgggaggctgaggcaggagaatggcgtgaacccgggaggcggagcttgcagtgagccgcgatggtgccactgcactccagcctgggcaacagagcgagactccgtctcaaaaaaaaaaaaaaaaagtaatttatttaataagaccatcaaaagtgtagaaataatacaaaataagaaaattatgtttaagcaatccaatgactggtgcttttaactatattttactaaaagtagcaatgtccgtgggtttaaacatttaagtagataaataaatacaaggacacttttgaaatattttcttggagatttttatatgatatttttatccatagtgctgtgtttcagaaaactgtaatactacaaatcctttcctaaacatggtttcacatcagacatctaccattaattgctagttttcagcaaccataaaagaactgcatcataatatgaatatttttacatacagtatccacctataatactcaactttttaggcagctcacaacaccagcactttgtcaccaacatgaacagcaaagcttgtcacatatactgcctgtgtgaattgtctctatagaagagtcaaaaattaaactggactttttaaaaataagagcattgtctctacagtcttgacagaaatttactcagacttgttaaagaatatggtcctataacatagtcagtgcaaggattatttcacatggcaatataaaatttatgagtttctagatccaattacatgtttctcactttgtagaaaagttgtctttacttttctactacacagttgattaatggaataataatgaaaaagaaccattttagagagttccattttgagtggtactccaaagaaaacaaaatcagaaagcaatgaaaacagaattgctaaattaagaacatgaagaactctgatattaaaaactgatgtatcacttcatctgtgtatacaaagaagaatagagctaattctctgggaaataactgaaatggcactaggctcatagctgttgtttgtggcttctcaggtctataacttttctattctctcagagcctctaagtgattgaaagcagtgaatggaataactatagggtgcacattatgatctaactgatttagtagatggagctcttctctttaagtctgtatttaaatgaacatcccagagagagtggggctctctcttttaaggtatgtcatactacacacataaaattgaggcctgcatagctggagaagagatttcctggtgcttttcaaaagacatgaagcatttgttctgaaatgcaaaaccgtgcaggggaacactaaggatggggtgggtttgttgatattcttaagtatgaagttaaatccagcagttattgtagaatatacttatttattagctgttttgtaaatgtagaaaaatatactgcacttgcaagattttggcgatattcattgcaaatctaccaagctatccaaactgtggagatctcctttcatttgattcttcaaaggaatcttaatactgtgatgcacttttttcatttaattagtctagagaacctgactaaaatgtcagtgtgacagcacagtggagggcaacgtaggcatattagtaaagtgcctttatggaagccaaaatattttcagcaataacagaaaatagattttcagtatctgttttaatgaaggaagaactgcttgttcatttctttttaaattaattaaaatgaataactgccacaaaattttcggtcagttttatattatattcagtaccaatagaataaatttgatcatgtctcttcctggtaccaagcggggaaatatatgtacactgtatgtaataaattgtagctctagacaaggccccaggcaaaaactgcaaaagagactgagtcctttttagtcctggtcacctctttcgtcttctcctctgccagcaaaacccagggtccttgtgttaatctgattatttccttcaacttcccctattccaatatgatccccatctcttcccgcagctccagtccaaaactgctttacactaagataactctcttggagtttaagtgattacagcatcaaaacatgaatgctttaagccctccatggcatatttgcatctcagaagtcttggaaaaccttactaacaaggagactttttaccctcctgcctgctcagaatcagctatgttccccatgtggctgtatccacccaactccctccctccctccctccctccctccctccctccctccctccctcccttccttccttccttccttccttccttccttccttccttcttcctttctgctttcttgctttcttgctttctctttcttttttaagagttggggcctcgttctatcacccaggctggagtacaatgttgcaatcatagctcactgcagcctcaaactcctgtctttcctttatccttgatcacacctgtgatgtgaactcagaaaagcaaacttttttctggggtagagagagaagggaatatagctttacatagtgaataatacccaggctgatagcaaagggtctctctttcaaaaatacgtcaaaatattacttttttgtatgaaaataagtttctatcttggatagccaaaaccctaacaggtaaggttacaagaatactgtaaacaacttaaaacccaaatgctttgtgataagtcaaggcttctacctcctgtgaaatctaggcattttgcaaatttgaataatcagtcatcttgagtctcttcttttgacagatgagagtattaaggctcaaactgcacacagtttttcttccaggtcacccaactcaacagcagagccacctcctcagatgcttttgatagcaaagttgtggaaaactggtagaagacaagtttgtacccgaacctctgctttagtctgcagtaaccttggctgcagtaaccttcatgttcttaatttagctattaaaaacattttagtgtttattaaaatgtttattttagctattctgttttcatggtataacttggtataacttcatagctttctgattttgttttgtttggagtaccaccaaaaagtgaatctctaagatgattatttcttattattattccattaataaactgtgtagtgtaaaagtaaagacaacttttctacccagcgagaaacataattggatccaaaatctcatacattttatatttaaattttctttttgtcctttgatggatcttggctctcttgcttatcacccaatgtaaatattccttaaggttctactttccttttttctctcaacagtcttctttgaagtttattcccatatttataggttgtagtgtagcctcttggccaatgtgtttgctagtcgtaatttcaagtatttctgctccactccaggaccctgtttgtaactcagtgttagttgtctccaccaggaacacccctggtagctcatattcagcactatacaaaatggaactctattctatccctctaaacactttccatcactttttgatatcttggagttatctttgataattgcccttcttgtacctaatattcagcttctggggcagtccaccctcatccacaaaatctgttgcaccaagctccgccattcctcctattaccagcccccttagggtaccaatagtgtgaaatactaacaatgctgtctgcgccctctccttcctccagtggctccctcctacatccatgcatcctccacacccttgctgcaaagtcttgatcatggcagcccctacttaaaacccttccacagctttacaacagagtgcaaagccctcattccttaccctaatgccttacctccagtctttcagaaaagctcaaatggaaccatttctgataagcctaagtagatatcactgttgactgggttaaaatgtactttacaaactttctaaattctatctaagataatggtgatgtgaggacatgtgctgttttaagattcttgatgggccagacgcggtggctcacgcctgtaatcccagcactttgggacgccacagagggcggatcacaaggtcaggagattgagaccatcctggccaacatggtgaaaccctgtctcttctaaaatacaaaaagttagccggacttggtggcacatgcctgtagtcacagctactcgggaggctgaggcaggagaatcgcttgaacccgggaggcagaggttgcagtgagccgagactgcgccactgtactccagcctagcagcagagcaagactccatctcaacaaaaaaaaacaaaaaaaaaattcttggtgatggggtctgtttgtctctacctttgtgccctcatgtaactcactgtagtgacaggcacataagatatattctatacatacttgccaagtgactgagtcaatgctctcgtggatctgtgtatgtggggacaggacatatctttaacccttctacagggaggttgtttgtgagtgttatttgatcttctctacaagactctaagtctctgagcctagggctcctgtttataaaactgcatcctgcacaatacctagcctgtagtcctctacactgaaagtatccactatattgatggatgagtagtcctgactcctttctgttcagaaaacataagttcactcagaatcagacttggatataggcagcatacatgatgagagaaagagcagggttctgtttctggctccgtcactctctatgctgggaaacttttgctaacgccacttgtcttatttgggcctcagtttattcatgtgtacaatagtgggtatacagtaatgctgaaaaatatttgaactggcacacattcctcagagagaacaaaagatgtagagacagaagaaaagcaaaaaaagaaagcagaaagtgctcattctgctgatgaggtaataaggtatttgactgtcgtacttactgtgaggtgactgatggaaggatctggttgaaatttccttacagcaaggaagtcctgaaataatcctcacgcacgtttccaatcaatcctaaatgatccaactccaagggtggtagtgcatgtggcctttttttaaagtaaggatgtgagaagtcttgacagatagggagaagcactaattttatataatgaaatttgccatgagtagagaagcacatgtgaaactgccacaagcagctgcagataaggattaaatatgtactcctgcataagatgtgatggcaagatgaagaatataaccctagaatcggcactagcttctaacaattacatgtggacaatcataagcatatctatgcaatgtttgggataacaatagggcatggtataacctgagacaatgggcaatgagaccagacttgccaagaaacctgggaggattttataaaaggacagattgctagaaactggaaagaccacaagtcaatgacaaagttccagcgtagcaactataggtgactgtggctccaggaatggacttttctcgttaagaaaagttattttgatatttactgatcaataaatcatcactaggtccctcggaatactttcttactttttctgactgtatggacagaagggcacttttgcctattagaaaataagcgggtgtcttcctttactatatattggggaaagcaaatgtctttaaaagggacatatgattcagcccagctgaattacaacaacaggcaacgttacccaaatacaaattgtcccacgattaaaatgaggcaaagtataagaaggtttcagtgtcataactgaattgttctgttttctgaaaacaccatgctcttcttatgcctctgtgattttgcttctgttccttctacctggaatgccattccctctgtcttctactttattagtttaatgtcatctttggtgtagaactctccccactgttacaggttccttcctcaggggctctgtagcattttgtgcatagtagaacactttaattctgcatttgtatttacccctttactggcttaataaagtgtttagtaaagtatttaggaacatcctgacttcctaaagtgaggggattcagtcttattcctatcttcatctctaatcctaggtaaggaattactgcattacgtgatcatgaaagaaacccaagtaaattagtattgtggggaaataacaagtttcatcaaaagagggtgaattttatatacagaggtagactaaaatgcaaaatatcaaaccctgtgctttttaaaaatgaatgtgtccccaaatatactaaatggaaactctaggaaattagggcaaattttttaaaaatggccttctaatgtataagtgctggactaagcactaaaaactctaaagaaagggtgtaaaaggtaatagaaataattccaaagagattatatatcagttaactcagaggaacaaaggtgacttttttaaaaagggaaagaatatctttaaagacaaaatccacagttcacagatgaggggcttacttggttaatgaaatgccagaaaaacaatttaaatgaacaaaacaaatatataatttctcaaagaacatagaataaagtagaatgtgagacactttggaggcaacaacagcacttagttatattaaagatgctctatttactgcttaactggtaggaaaatttattagaaaataaataacaagccattggaaagtaactctctgtggctgttattccatcccattttggctatattttctctgcaaatcagtgtgacctcaaaatgttttcaggattgtccaacttgtcctaaattccataaataaactctttcagaggatgctgttttttgccatgtctctattacaattcttcacagatggaccatttttgtccttccaaagtctaagaataactctttcatttatcaagacacacaaaaatccagttcagctgcttctgtgggatccagttagtttagacacatctgctaaaatacatgcatttgaatccaaatgaagcttttgtttggttattatacattttgaacatttatggagttttttgggggccaaaacatttttcattttttggcacaccaaacagagatcttcagttataaatactaccttctgagcacctccaacagaaatccaatattttcatgtgggtgcctcaagaagtttttggaaggttttatactgaatcaactttctgaccagaaactttctgaacatgcaatcaaatttgccaaagagaccttcaaacttgcttgagcagttttcactcacacagacatacattcacacatagagacagcccaagtaaaagtaaatcagaatcctgtaaaactgaaatatctgtcttaaagattaaataccatatgcaaccagactgaacaaaaagaaatacatgacaggaaacagaatgaacaagtagcaagaacccttaaagccttacctaagagtttaagctacacatcctttcagtaaaatttttttgtctcatcaggtttcaaatatatactcaagcatttgcatttttaaacactgtatcagagtattgctactaatttctttcattcacaaacctgttcaaacagttattttgaaatgcttccttctctaacacaaatgggtaaaccagatttaaatgtaaaggaagaaaaaacactactctttcactcaggggttctttggcaaagccctcatcttgcttgattcctcgtaaattttacttgccagtttgaatacagcataaaattaaaaagttgttatagcgcaaaaataactttttaagccttaagcctaaaagttattacagagtaaaatcactttcccagtgggcatgcctcgaattcaaggggaaatatgctttcaagttgttcttatggccatgaaccagaggctctatggtggccaaaaacctttgtctatacccacttagcagatttctggctccttatcagaaactaaaatgtttatttgcagaaatgaataatttccttcaaaatatcccttaccctatttacatgcttgcatattcctcccattttgttttccccttacagctttattaggggaattaattatatggaagaataggaacatagagtaagtacatctgagatacaggatgagacacagtatgtcatctgttaggcctggttaaagaccagcagctgatgttaaacgggaaggaacatgcaccaaatgttttttaatcacaaagctagtaattactttctctttaaattacatttatgcttctctctgtctgtgtatatgaaacgcacatttattacatgccaaaaattacactatggtttaaatgtgactggcacggaagtctggaaatcagagttaatgatgttcccacagcaactttaattctgtccatgttcacatagagtatgcacgtagagctataataatgctatgtaatcagggaatgaaagaatctgctgtgatgccaacactcaggggacagtttccgttgttgtgggaacatgaactttgcatttcctgactttggaaatgcagctttcatgcggtatttgttttgttccctaaaacattgcttaaaaattcaaaatgagtaaagtgtactaaaaattttaatcacagaaacttggactggtgaagcaaatggttgggaaggggaagaccaaggaaggtggatggcaagaaatggaaaaggaagagctcaccggtctcctccacagtgttcagccccagcaaagtcatgctacctacagagctaaagttaaacgcacccatacaacagtttggtaatgtgtagaggttcaatgaaaaataagtaaaaactgttcatgcataagtgcatcatggcaaggagacagaaaacgagacagtctgatgaggccagtgtaaaacatgggatatcagcttccaacaaaagaataggtgaatctacagccaaaagtggggaggaccaccaaagggaggaaaatcacttccttcaatgagagccttatttgggagaaaaccaaatggaagaaatatgcaagtaaaatttctggttgtgtctatcaaatgtacatgactgtgatgtgctacagcttgatagctgtcaagaaagttttttcatatggagagcttcacctgctctactgacttggtttagtcctgcttaagccgctaaagcatttaaaggcggagcttggctgagctcatactcagcctgtctagtgggtaactgctctgtcaaacacctaggcttttttcacttttggattccataactcatcttaataccttctattatcactatctgaatttgtttactattagagttttagaaatggtgaaggggtgataagctaggaggcaatgggggaatattactcatagaaaattgtgtcagtgggcgcactgcaaaacagcacacattttagcagcaatattaacctcaccatctcacaaaggaaagcatatctcaactgtattcattcttgttttgaatattactgggatcttttgccaaatttgaagtggatcatcaggtaaaatagccaactgagaatttagggggtcagacttgtcatcttttctctaaaacaaggcctgtgtcattcatatgccaaaagactgtggcttacccaccttgccagttcatatgcagagttgacttttcttcctgtgggtatgctttatccattatgttttacaacccaatcaccaatataagttgctcattttcaagatccctcttcagagtcaggaatgccatctttggtctcgaaatttcctaagagaaatgctctcacaatgaaagcaaacccataaacacccctcagtattcaaatgagttaaccacaaccatgtcattcatctaactgggtgtccatttcctcagttttctcacctgtaaattgggaaagatcatactgactgacaggaaataggcattaaggcatgattaagatcaattttgctaaaaacacaacaaataaaaaggtgctataaaaattcaggcacttgtggaaggttggacaccacaacttaacggaatttttctgaagtaaaagagactaacaaatcaagggcattatttttagatgccccaaatctgttagttttaaataggaactgaatactttaaagaaattagatgtttaaattaatctatggtaagaattacatttgaaagtaaaaacaaaaatcctcttgaatgcaagaagagcatccgaaaattttaacagcttaaaatacacggttttcctgtcttctcccaagcaatctttaaatggacagatttctgtgcatcttttctaaaatcaattttcttgtaagtataggctcaagtcaagacaaactacaatccaaatatatttgaagaaagtataatcaatttaaacaagttgaaacagggaagacttacacatcttaatggtagaatcaaaatgactttctaaacacctggagattagggttcttctcccagtttgttcttccaactacattcagacaaactactgagctcaaatcctctggcttcttcagggccaacaaggagctatatggtgacaccatactcgcacaattcttaaaacatatttcatgccaatgccaaggcctggacagagaatgcttatgttaaagcacaataagtgccccaatgccttttctattaagtaaaacattaatttttgctgtaacataagatttctgggctaaggcaattgtatataatccacacccagaaggtgtggcagaaagccaggtaatgaaggtctgcatgtagaaaccccaggcccttcaccatgtgaaggggctactttcctggtgggtaaggacagcatgcacctgcctatgggcactgtgccatgctcctttccaattcttcctgtaattactactatgctggagactgctaggcaagaaggtccaaggaggtgactattaggatggtccaaagaacacaatccctgcttctgccctctatagaagctacaagtttgattgtagcttctcaaaccacatgggccatagagatttggctcacgttatttctctttccattttctactgacagctggagggtggtctcagcccaaccataagtagaccaagctgtctttactccaaccctccccccaggtcgtttctctctatttagagactatcatgatgaagtaagtagagaatggaatctcctggacccatttacctcttgccgtctttgcagaattttacatttttttttcagaaaaataacaataggagatttagattctcatttcctaattaataatttttgtctttgtggacaggattttatttttgaaataagactttgttggtcttatattgctcattttaaagaaaaagtttcctaatttttgcatgttaccagatatcctttatggagatcagttcagaagaattgttgggtatcttaagactaaaaggaatattcttttggattcaactgcaaatttatttcatgcctttccattggcaacacatatgtttctttctctctgaagtattgggttacgtttcagaaagaaaagaaaatctcctaaacgtgatttatcaactttcttgaaatagattttaaagtgacttccagattagtgtgaatatggcaaaaataaacatcacataagtgatttcaatagtgacaatcccattaggctgcacatttccaaatttagcacataggcagttttttctttttctttttcttttcttttctttcttgctttttttttttttttttttttttgagacaaggtctggctttgtcacccagggtggagtgcagcggcgccatctccgttcactgcaacctcagcctcacaggctcaagccttcttcctaactcaacctcccgagtagctgggactataggtgcatgccaccatgcccagctaatttttgtattttttgtagagatgaggtttcaccatgttgcccaggcgggtctcaaactcttaggcttaagccatccacctgtctcagcctcccaaagtgctgggattataggcgtgagccacatcacctcgattgtttttctaattaaaaaatattttaaacctgaattctcattggctatgtgaagtctgcatgacttctgaacttttgaaagccattatcttttcttatgtaaattttcattatcctttaaccatttcaaataaattaaaaactggaaagacagaaattcagccaagctacatgagactctaataactagtgcaaatctggcttgtgttatgtaatttcaaaatggatgtttccttgtgtctaactgaccttctgaggtccgtgtttggttgttcaatttaataattgaggaagtgccattattcagatcaagaataattagacactggcaacaaaacttctttttctgagttagtgttatgaagagaatgtggtttacgtaattaatcaggctttgaggccaaatggcttgtcatttggctttaaaatatattctagctttgaaaatacacagatgttggctgaatgaaaatggtggcacattacttttgactgctttagaagactgaaagcaaacagcttgtttggaaagtaaaaaagccagaacccagggagaagcactactccaagcactgccaagacaccatcaccttggtggtgtacttacaatcagatgaccctgtgtgagcgagtttgtcagtgaatgtgttgagtggatatgggctgggtctggagactaaacagcttcaaagttctggcagggaaggcctagcttggcgctggagccacctggctgagtaatctcattttgctcagatgccttctgcttttcaggtgtctcgggcttcttcctgcaattaaacaaagggccctttgaaggaactgactgcatatttgggaagaggcattttagaatcttttaaagataacttgatttttctttttctgaacgagtatgggaggtagtctaatatgtcccttgttttgaaacaagatgattcttggattttgttttttttgtttttgtttttgttttttttttcccccttcagtaaaggcccaactgggaacacagcactacattcgcactctgttggctatataaaaagaccctgtcccagaactttagagagtgtgagctacgtatggctgacattatccaagaaagcatcccttcttacctccttagcagttttaacacggtctggaaaaatactagtggaggtttactgttctagagtttgtcaggaagcttcaaaacaagattcatggaggaacgggaggaacactggactgggagtcaggatatttagctatggaactcgctgtgcctctcagttgctgtctggcgttgggcacctcactttacctctttgtgcttcagtttcttcatctgtctaataaagggcttgtgttagaaggccttcaagttttcatccaactttaaatttctacttaattaagtcgagcattcaacttttgtgctgttattttattttagattttattttaaatcgatacataatttcaaattacaatttcaatttgcaggctatacagatgaagtggtagtcgtggaggtttttcttagagtagcaagtgaagcatgtaaagaagagctcagacatttatgcagccaaaagacacatgaaaaaatgctcaccatcactggtcatcagagaaatgcaaatcaaaaccacagtgagataccattttaataaacattaaaatgttttcaatagctaaaataaacattaaaatgttttttaaaaaacattttaatatttcaaataatgctttgctaactatatggttgattctaagttatgggcctaccatcaatgcatattttccagtattcataagggagatgtattattttacaaatattttacaaatcaagcttactatctatagtaaccaattaataagacagctcatgcatcaagcacactttcatcacaaaatagagcaaagctttcaacacatatctgcttgtatgtatgatccatagagaggagacaaaactgaagtatgacacggttaagagtttgtccttttacatagttaatttaactgatagctgaggtatccatttaaaacttagatgcttgatagctgaggtatccatttaaaacttagatgtttttggttgtgatcacacgtctctcacatgccagcaaagttgtctgagttctccactacagaggttattaatgtaaacataacaataagaggctattttagaggcctcagtttgcactgcccaccccaagaaagaaatgggaaagtcttataaaataactagaataagaaaacagcaatggatatgaaaaacagatatatcacttactatctgacacaatgtggaatatatattatttgtaaattattttctcatattccacagtgaataaagtaaaagcattactctgcctaaccactgtgtgtaccatccacttcactcaacagcttaaaagggtaaggaaggaaatcgatggagctgaatcacactcaatccttatgtggcatcctggataggagaacaaagcattaaataacactaatgcagccccctcattagcatttcttgctataaaagatatatggctgacaacaatgttcttgaattacaagtatctcccagacacctacaaagctttcccacatattttgaaattcattcctggaagaaattacttttttttttttcactaggtgtgaataagataccacgcttgtgttgtagggcatgcctgatgcccagtgttttaaacacaaaatgtgccacgagtcaaagttgatttttctgaacttactttactaggaggcacaattacattaaacacattaccacatgtcttcctcatctgtttctgcaaaatgactactttcgggatggctgtgcattcctgaattccgtgctgcactgaaaatttgaaaaggcaaacgtttttagaggaaggatgctattgtggacattttttcacatggaaatgtactatttgtggatttgtatggctgtttgccaattaaagctttaaagcagacctatatacatggagtcccttgagccctgaccattttacagagacatttttgcaagccctccaggactgaagtcatagataaccatgcactgcggatcagactccttggacgtcacggactgcacacatccagaagagcagctctaagggcatctgtaactctgccgtggggcaggagcttcccatgggaaacctaaagcccttgaaactgctttagaaacctagggcttcttagcatatgcaaggtgggcaccaaagtaacgagggtgccacgggctgcccatgtgctccccacgacccggtgcaaggagataagacagaccgtccccttgggcgggcacctgtttccttgacccttcattccagttttacgtccatgccccgtttcctgggctaccataaactgagtttacagcagggccttgtcagcctccctgacgcacttcccgtccatacgcaccatggctggccgtcctgggaggctagagacgactcctgaaccttgtgagtgcaaagacacactaaggaacccaggtgtgttaaatgagagccaacggggaggtccccaggttgaagaagagtggggctggcatgctccgtgtctactgctgaaggagcaaaggacaagggagaagaggccagcgtccccacctgtcccgttgtgtcccatccagcccttccctggggctgcctgcagagctcacacctgctccgcacacctgaactccaggtcctctgctgaattcttgccgtgcccttgggacagagattgcccctgccccgggtccccaagtgaccccgtgttggtcgggagagctgtagggtgacacaggacctccccagccatctgcatgggaatgaacctctgtgtacccgtcctcgacagtcaggtgctggcatctgccctctcacctgcctggacgcccagcagacccccggtgaccaagggtcccatccagatgggtggccgagcaagagggacacacgcggactctcccccagcctccagcacatgcacagaacccagtgatgctcccgggcactggggaccacctggacccctcgatctcccttccctggcccacgccagcctgcccctaggggactctccctgacccaggccccaggtgacgctggggagatttcctcacaggtcagcctgagctgccccaagatccacactctcgtcctctgaggacctcggactacacggtcccagtctcccctccggccaggtcctctcctgaggtaccctcgacctctcctcctcacaggacctccaggacctggcaccttgatgctcctctgagggcctgggtccttggtcctcgcgagagcagctggcctgactgtgggtgccctttcctgattggctggctcagtgcatgtgggaggtggggctatgtggagccacgcccccccccccccactgggcacgccttcccctgagggatggcccatggctgctgtggactggacttccacccctacggtcctccagctcctcatcctggggaaggacagaaggacctgggagtggagtggggagcagctactgaccctgccctgagaggtggaggccatgtggctgtggcctaggaccttgtacctggactccttccagccacccttctcctttgggagaaatggccatcaccctggaagtggggcccaggctccctcccatgccctgtgtgcttccaacacgcccagctgcatcccaggcattcctgctgtgcgtcccgtgcacccaccacatcacaagacctgcttccttatctctgtgggattctgccccttcctccttagctcaccgttgagtcacttagggtgcctatggggtggcaggtgccgtcctgccctcatctcccctgttgcatcaggtacccgtgtggggccactccaccccgcatgcgtccatttcctgtccattcacctctgggcagggctgttgtgaaagagggctgctctattgttgtggctagggctgttgtgaaagagggccgctctgactttgattaaatgttgtggttacctgtagacatgctgctttcatttcccctattccatcacctacctctgtggggctaatctacaaaaaatccgcttagttctctgtctatggacatgtcagttctttccagtgtcagtcccttctaagcaaggatgctatgaagagtgagatgtctggcatacgtgccaaaggtttacacggtatcagagagtggaattcctggatcatagactcagggaatattccccagtgctcaattgtttccaagaggcatcccccaccagaagagtgtgttcccactgttacacagactcgctggtggaataggccttttgcttaatgctgtcattctagtgggtgtgaaatggcatggatttgggatcttgcatttctccagttactaataagactgggttctttttctcggctgtttgcatatccttttacagtacaatatccatgttggtgaattaaccatttttcactttaataagatgtttttcttccagttcttatatattgtgaggctaagctttataactgtgtttacctgtgccttttgtaataaatttatcttttctctgaagtcataaaaatttcccctctattttctaataaagattgtgagatttaatttttcatgttctttttaacctttaagttcagaggtatatgtgcaggtttgttatagggtaaacttgtgtcatggggctttgttgtacagattatttcatcacccacttattaagcttagtacccattagttatttttcctgacttacctacaattgatttttgtgcctgatgtcaggtggagaaccaattcctttttttccttcccgtgcagaaattcggttttcttgtcctcattagttgaagagcatacactttccccattatcagcttatttactgcaaagtccctctttgttcctgctgatttgaaatgctacctttatcatactcccaatttgcaaatattactgggtcgtcttatcactttctagaatgttgccttggtctgtctctctattcccatgccagtgaataccacagtgttttaattatggaggctgggtgtatactgtaatgtgtttggggccagttttcccatatagctcttcctttcccgtgactttgtagctattcttgccttttgaaatgggcattatgataccatcttcttctctccaggaaaaagggaatggtgttggtatttttatggaattgtattaaacttataaactcacttagggagaaccaacatcttgatgatgccgtaatgtcctaacactgaacaaacgatttctacccacttgcccaagtctgcttttgtgtctttttaaaaggcaccgtatagtgctttcaatatgtcttaattttatgcctaaatattttcatcattcttgttgcttttgtaaatgattgttttatttgtaattgtatcccctacctggttatgttttggtgggcgtggagccttttgatctgagcagtagctctcaagagtaggctttggtttggagaaagtgcctatgaaacagtctgtgcctggtggtctcatatgggagatttccttcgtaaggctatttcctctgtacaaatgttcttttatccttttgggcgctattggggtcaattatatagtgagtgtattttcacaagaaattacatagttcatatagttttacaaggttatcggcatagagatgtgtaaagaggcccctctgatttttaaaaatttcctctttattgttatttacaggcatacctcaaagatattgtgggtttagttccagaccatcacaataaagcaagtgacatgaattttttggtgtttcttgcatgtaaaagttaagtttacagtatattatagtctattagatgtgcaatagcactatggcaaaaatatatacataccttaacttaaaaagagtttattataacaaatgctcaatatcacctgagccgtcagtgagtcatacactcttagctggtgtgaagtgttgcctcaatgttcatggctgctgagtgatcggtggggtggttggtgaaagttggggtggctgtggcaatttcttaaaattagacatcaatgaagtttgacacatagattgactcttcttttcatgaaacctgtctccatagcatacgatgctgtttatagcattttactcacccatagttgaatatccttcaaagttgtaacgaaccctcttaaaccctgccactgctgtatcaactaagtttatgcaatactctaaatcccgtactgtcatttcaactactactacgttcacagcatcttctccaggaatggattccattccatttcaagaaatcactttctttgttcttccgtaagaagcaactccttgtcccttccagtttgatcatgagattgcagtgattcagtttcttcttcaggctccactactctttctggttctcttgctatttccatcacatctgcaggtacttcccccactgacattgtgaacccctcaaagtgatttgtgagggttggaatcaacttcatcctttaatgttgatattttgacttcctcccatgaatcacgaatgttcttagtggcatgcagaaaggggaatcatttccagaaggttttcaatttccttttttcagatccttcagaggaatcactatctatagcagctacagccttatggaatctgtttgctaaacaggaagacttgaaagttaaaatcatttcttgatccatgggctgcagagtgaatgtttcatgcatgctagcaggcataaaattaaaaaaaaaaaaaacctccttgtacatcttcatgacagctcttgagtgaccagacacactgtgaatgagtggtaatatttggaagggaatctttttatttctgagcagtaggtctcaagagtgggcttaaaatcttcagtaagtcacgatgtaaacagatgtgctgtcgtccaggctttgttgtttcatttctagagcacaggcagagtagctttagcatcattcttaaaggccctaggattttcaaagcgataaattagcatcggcttcaacttacagtcaccagctgcattagccccctaacaagagagtcagcctgtcctttgaaagtttgaagccaggcattgacttctcctctctacctacaaaagtcctagatggtatcttcttccagtagaaggccgtttcatctagaaggaaaacctgtcgtgagcacagccaccttcacccatgatctcagctagatcttctggagaacttcctgcagtgcctccatcagcactttatgatccatcttgcacttttatgtgatggagatggcctctctccttacactccatgaaccagtatctgctagcttctccttttttttgtttttgttttttgtcttgttttgttttgttttttgttttttgtcttttttctgcagcttcctcatctctctcggcctcagagaagtgaggaaagatagggctgtgctctggattaggccttggcttaagggcatctggtggctggtttgatgatatgtccactaaaactctctgcatatcagcacgaaatctgtttcgcttccttatcattcatgtgttcgccggagtggcacttttcatttctttcaccacctggctaagactttggcacaggtggtctagtttggggcctatctcagcttgcaacgtgccctcctcactgagcttaataatttctcccttttgatttaaagtgagagatctgcaattcctcctttcacttgaacctttagaggccatcgtagggttattatttggcctaatttcaattctgtcgtgtcacagggagtagagagaccagagcagagtgagagagatggggagaggccagtcagtggagcagtcaaaacacacacaacattgattgattaagcttgcttcttctagggtgcattttgtggcttcccaatgtgattacaatagcaaaatcaaagagcactgatcacggatcaccaaaacagatatagtcctactgaaaatttgagatgttgtaagaattaccaaaatgtgacacagagacacgaggtgagcacatgctgtgaaaaatggtgcccacggattattcaaatcagggtcattaggaaccttccaaaacaagctgcatctgcaaagtgcaataaagcacaatcaaacaaagtatgctggtagttgtgtgtctcctgtgcaaacatctatctatcatctatctatctatctatctaatctatctatctatctatctatctatctatctatctatctatctatctatctatctctatgcctgtctatctatctagctatctatctacctgcctacctatctacctgtctgtgtacctattatatatatacagaaacactatctctgcttctttgattcagttagctactgcttcatctgcctcattgatttaaaaagacactcttcaatatttgtgtctcctatttctgtttctccctcattaatgtctgctttatatattaacattattacttgttcgtgctttcttttaactttgttttatgtctagcccttgagctagaaatgtcactgattcatttttatactcccattgtcatggttatgagtattcaaagcggtctacttttctctgatcacctctttaaatatatgtcatagattcaaatctatagggtttattataatttatcagaaagtagataattcctcctcatatctaggccggcacccagtagttctttaacagttgatttttatgagttctggggcacgtgagcttatttacagcttttagttgtattgtactacgaccacagcagtagtttgtgatatctctatatgtggagcttactaatgttttcttcgtgacctcacatatgatcaatttctgtaaatgttctttgtaaacctgagaaggtatattttccagtatcatgttgtagtttcaatacatgtacattagttctaccttttcaaatatgtttaaagtgttacagtgggctgtgtgcagtggctcacccttgtagtcccagcactttgcggggctgagatgggaggatcacttaagcccaggagctcaagaccagacttagtaccacagagagatcctgtttctaccaaaaataagaagattagctaggcatgacggcatgtcctggtagtcccagtgactcaggaggctgagacaggaggatcatgtgagtctgggaaatcaaggcttctgtgagtcatgaacccacagtggcagtgacactgggaaatcagagccagactctgtctcaaacagaaacaaacaaatctcatgtaccccataaatatatacacctactatgtatacataaaaattttaaagctaaaattaaaaaaattttttatgttacactgttattcctttttaaccatttaactggttgtggcaaattgcattttctgaagatggtcacagtaccaccttctttcccacaagctcttctttccatgtgacctggggccctgctcctatcaaggagtgcagcctatatgtccttctcttggactcaggcagtgtatgaagctgctgagtgtgagagaggaccacacaagtgaggatttctgtctgtggagactaggacacaaaaatgccatgaaatcccaccttgctccttcaggacacttgatctgggaacccacccattatgctttgaggaagctcaagcagcccgtggagaaacccgtggagagcatcagaggctcccagcctcagctaagtttccagctaataaccagctgcagcttgccagccatgagagcaagccatctttgaacgtggatcctccagtctccacttgagcaacactaagtcgcatccttgggtcacagatgactcacctccattaagcccccaaaaaactacatgatgatttttattttcagccacagaggaaatcctcccctttaaccagagctctatttccccccaagtccccttaggagagcttcatgacagctgccagctttctcccagtatctctcttacttgctcactccccattccatctctctacatttcctccttccgttacctgactcttctgttttgggttccctatctctgtcttataggagcatcactttctctctcttctctgctctactcacccttcaggtttgctccttccactcccaactccctgtcacacgcaccatttgtctcccttgctggttttgtgacagaacaattcagacgaaatcccccaaaacttctgccatcaaacctacaagctacctgcatctgtgccctgtctctccctctgttagaggaggaaagacgtccctgcccctgtgttctaggttccatggcctcctgtcttccagaaacctcgtgttatccattagtttatccattatctttctcctccctctatcttctgcatgtctttctcttgccatccttcttattcccatttgcgcatactcgaatctccttcaacttgaaaatccctgggccttattcaccaccaatgtaattcccaccactctcttactctttgtgtcaaagtttccaaaggattatctctgcttggtgcctctattgcctcatctctcacattttctgtaatccactagaagccaacgtgggcccgcacatctcttctaaaaggattctccctcaaaagtcactggtgacctccatgtgactagatctaatgcacattctctggcactcatctcagttgattctcagctgcggtcaacactgttgagcactctcctctttttctcagtgccctccttttgtcttcctttgtcttccataacaacacattctcctgttattctcttcatcttggccacgtctcaatatcttttctagcagcaccttctccacggggccctttcaagatggaatttccagggatttgggtcttgctcaattctcttccagctgtatactctttctctatttattttcatatatggccataactaccattaccattgaaatcaaagtttctcaaagtgtgacttgtggaccagcctgtatcagggtcacagtgaaagggatttgggaaagtttggatttcatggccctcttcaggcctaccaaatgaactctctctgtgggagggaatgtgaaatctgcattggaaataagttatccaggttgttctcatacccacacactatgcgtcagggactgcctggctgacattaacaatggcagctcaacgcctccatctggtggcttttggacaccatcgtcttctttttgcaaatacagtccatggagattacgaaactattgaaaatgtgaaaaatgagaaagaagtaaaaaaacaggatatgaatggagtctctactccacaaataatcaagactgaattacatcattttatggcatgtctagcacaaagtagaacttgtctatattacagttttgagagtaaatccaatggacacatttccattttcatctaagggcaggaaaacacaggtattggatgactccccctctacagatcattacaccaagtttctaacttctaagaatgctgcatttaatgaatttgtaaagttagtcttccagaagttagctaataaagaaccctctgctttccactaataaattaatatgggttttgattcccatttctccgatgattagtgatgtgaatcacttttttcatacacctgtgggacattggtatgtcttcttttgggaaatgtcaattcagttccttggcccactttttaaggggctcctttttctcctgtcgagtcgtttgagttcctcgtatgttctggatatcagtcacctgtcgggtgattagtttgcaaatatcttctcccattcaataggttatttctttactctgctgattgtgccttttgttgtgcagaagcttttcagctgtatgcactgtatttgtctatttttggtcgtttttgctgcctgtgctttcaaagtcttaggaattctttgcctagaccggtgtcaaagagagttttcactaggttttctcctagcatttatatagcttcaggttgttttttgtgttttcttttattttactttgttttgttttgctttgctttgttttgttttgttttgtttttgagacggagtctcgctctgtctcccaggctggattgcagtggcgccatctcggctcactgcaagctccacctcctgggttcaagcgattctcctgcctcagcctcccgagtagctgggactacaggcacgtgccaccacgcccggttaattttctgtaattttagtagagacggggtttcaccgtgttagccaggatggcctcgatcgcctgacctcatgatccgcccgcctcggcctcccaaagtgctgggattacaggcgtgagccaccacacccggcctcagctcttttatgtgactccttaatctatttgcgttcatttttgtatacggtgagagacacaggcctaatttcactaaccaccacagaaatgcaaaccaaaaccgcaatgacatatcatctttcctcagtcagaatggccactatttaaaaagacacaaaataacagaggttggcaagaataagaagcaaaggcaaatcttacagcctgttggtgagagtgtaaactactacagccaccgtggaaaagagtatggcgacttctcaacaaaactgaaaacagaactaccattcgatgcagcaatcccatgactgggtatctaccaaaaggaaaagaaatcaatatattaaaaaaatacctgctcttgcatgtttactatatagcactattcacaatagcaaagacgtggaatcaacttcagtgtgcatcaacagatgaatggttttttaacaagatggtgtatatatgtatacatatatctaggtgtatttgtgtgtgtgtgtgtgtgtggaacacaattattcctttaaaaagaagaatgaaatcatgttatttgcagccgcatggacggaactagaggccattatcgtcagtgaaataaagtaggcataaaaagacaaatatcacatgtcctctattatatgtgggagctaaaacatctgatcgcgtggagctagagaatggagaggtagagaatggagactgggaagagtgagtcagcaggagaaggatgcagagaagtgcgttgaagggaacaaacctacagtaagatagaagcaatcaattccgtgtttgagagcagagtagggtgacggtccttcacaaaaatgtattgtactcaggcgacggacaccctaaatatcctgacttaatcactacacattgtatacatgtaacaaaatttcacatgtacccataaatttatatacaaaatacaaaaattaaaattaataacaaataaatactataatatgaggctctctaaggtaacttaaattctactttcaagtctgtgttctagttaaaaatgtaatacatcttcactgtaaaatgttatgaaaatataatttataaaggaaatgaaattcacacataattccaccaagcagatataatattccatttaaaatcccgggtattatttcctttcatccttttctctctctagatagatagaggcgtgggtatacataaagacatagctatggactcaaatagatacagctatagattgtctttacgtcttctaaaattatctttaactttcgtacctgtctttgtttgctaccagctctgcaagtttctttctgtttgtaatcatgcattttccttctttcatctacatttagcaaagtcttcaagactgtattcactctcatcgtgctttcccactgcctgtgcgagtaacaggttaaaggtaaggctactgtatcctattccctttgaattcacttgcttgtgaccatcagcatttcactggctcatagcaagccaccaacgtgttgggtgaggaacaatgggcaaaggctgccagagcccttgctgtactacagactctttgtgagatcatataattgaatgtggtttcctacagtaactttactgaaaattatctctcgtttcacttactcatgttaaacattgcctcagattgatctccgtcacaatggcacgttactactggaaaaggcatatagtagtctgaaaatatctggagatttcaccatgtgctccaagaggtaatacatagatgtctacgtaccatagatacatcaagatttcataactcatctcagtgctaattctaagaacagcacattgctaatactactccaccttgatcactgccaatttactccttctgattacctagactcgtgacaaaacattttctcactgttttagaagcccgtggtgtagaattttctcaaggccatttgacggcctaaatatcacgctttgttgtttcgttcatagtctcaaagaaatcaaggtgagagtctggcttttagagaagcactcagcagactaaatattgctgatcgatattgagatgtgggtaggagtttaacacatgaatgaggacggaaaagatggcccatgcaataagcaaaataggatccaggcatgtgcaagggtatagggacggagaacataggctcaacgtcattactcttagggaaatgcaaatcacaccacaatcctaccagctaaccaccccccaggttgtttactttcaagaggaagacaaaaattgctgctgttaaagatgtggagaaactgcaagccttatacactgctgacgggaatgtaaaatggtgtgtggctgctacgaaaaacagtttggtgtttcctcaagatgttaaaagtaatgaacatatgacaccatcattccactcctagatacatgcagaaaaatttaaaacagacattcaagcaaatacatgtgtatgaatgtccctaacagcaccatggacaacagccaaataggagcatcccacattaccaccaacagataaatggatgaacacaacatgatggatccacctaacgggatactccgtagctgtgagaaagaatgacgctctgatacatggtacgacgtgggatgaacttggaaaccatgttacgtgaaataggccagacacaaaaggtcacgtaccctatgattccatttctatggaatgtccagaagaagcaaatgttaaggattagcgatacttagaaatcaggttgttatcatgtcatctgattacaaaacggatgagtggatgccagggaaggagggaggcgggaatcagtagtgactgcctcatgggtacagggttttctttgggattgatgcaaatgttgtgtaaatagacagaggtgatgattttgcaatactgtgaatttactttatgccaccaaacggtatgcttaaatgtctaattttatgttatctgagtttcacttcaataaatatttctttcaaaaataacaattcttagacccatgcaatatatgttcaagtgttttgaaaaaacctgagctatcaattaaatgaaaatttcaatttaaaaataatcttcagcccattcatgtttacatacaaatatggtccatgaaaaataagtccatttttgacaacaacacaagtatcgaaagaaatatgccaaagaaattatcaacagagtaacaaggtaacctgaagaatggaagaaaatatttgcaaactgtgcttgcgacaaagaactaatatgcagaatctacaaggaactctacaaaaacagcaaggagaaagagcaaataatcccattaaaacgtgggcatatgacgtggacatttctcaaaagaggatatacaaatggacaagacatatttgaaaaaatgttcaacattgctcatcatcaaggaaacaccaatgaacaccagggtgagatagcaccttaccccggccagaatgaccacgattaaaaactcaataaacaatagatgttggtgcaaatgtggtggaaaagaatgcttttacgctgctggtgggaatcaaaattagtccaacccctatggacaacagtatggagactccttaaagaactaatagtcgatacaccatacgatccagcaataccacgactgggtatctacccaacggaaacgaagtcattatgtgaaaaagacagctgcacatgtatgtttatcgcagcacaattcacaatcgccaacgtgtggcatcgacctaagtgcccatcgactgatgagtggaggaagaaaatgtgtatatacaccatgaaatgctagtcaggcgtaaaaaaaagaacaaaatcgtgtcttttgtggcaacttggatgcaactgcaggccattatcctaagtgagctaactcaggaacggaaaaccgaataccgcatgttctcggtgtgagctaagctataggtacacaaaagtacctgatctcgtgtgttctggcggtgggaaaggtggcccctcagggaacctggctcccacgtccctgtgcctcaagggagaacagaacctgtgacgccttcacttgcctccctccatgacccgttctgtgaaacttcccctgcccccagcgcctaggccaaggagaattcccagccctgttgcgaatcctttcttggttcccgcgtgagattgagcggggtgccactgagtgagctccagatcgacgctgagcctcgggggatgtattggcgcttcctgctctccgtagcaagtcgtcatccagcagaacctcgggacgacacttcggtttctatgacaaccaaggtaaacgtttctttcctggcggcagacacacatcgcaaggatatttacagagcggacagctggaatagctgtaggaacgtcaagactagtaggtgtctgctatcgatgtgactgtgtcgggggcgggggggaggtgagggcgtatgtgtgaggatgtgtgtctgtgtgtgtgtgtgtgacggtgtgtgcatgtgtgtgggtgtgtgtgtgtgaggatgtgtgtggacatgtgtgtatgtgtgtgcgcgcgtgtgtgtggatgtgtgtgtgtttgggggtgtgtgtgtggatgtgtgtggatgcgtgtgcatgtgtgtgcgtgtttgtatgtgaggatgtgtgtgtgaggatgtgtgtgtgtgaggatgtgtgtgtgtttgggggtgtgtgtatggatgtgtgtgtgtgaggaagtatgtgtctctgtgtgtgtgtgtgaatgtgtgtggcattgagttgactgtcctgactcactgtcctgaggtgacacctgttgagccagagcattgtcacccgagtcagtcctttaaagcagagatccacaaggatttctgaactcaaaggaatgtcgcaggtctccttcaggatggaaatttgctcgcctcctcattgtaagaacgtacgatgcatacattaggagagggaaatctgatgccggcaaatgaggagctaccatgggtaggactggaaggcctcctgtcactttgagcaggccgggactcatgctgggctcatcctgcgtagctgacccttgagacccatgttctgtaaaaggtgaatttcctggtctcactccgctaactacgatgaggtgaattgagtgaaaatcagtgagggccccttctcgatgacagaagcgaaaaacacaggctccttcaccagggcgggccattgtgttcctattgtctaccaaacggctctgctctccaggtcggagagcggtgcaattgttcactaattgcatcctctactgatgcatgcaattagtgaacagaataaggggaaaactggaccgataccaattctcacccaatggtgctacaagtgcactgcaaaccctaggaaagcgtagacctgtctctaaagttacgttgaaagtttatgtgcaattcaccagcgcaaagggaaggtgtaggaatacacaagaatgtacttcctttagagaaaccatttaatacacggtgcctttattgtactaaaggatgccgccagctcatcctttgaaggaaacacctgtttgggggaaggtctaaaatcacacacccagcagccgacgggagctccacaaagctctggtaatgctagggaggggtgctggagggaggatgcatgcctctcggtgggagggggaccacgtcaggaaacggaccccactttgagaagagctgctgaggactgtgttcttttacttgttcctaaaaagtaaatgaaccctcacttgagaaaggaattaacacagggcttccaaaataattatcccccaaatcatggctgtcgttgggagaaataaaagctcacggtcttctagttccttcatccctcaactaaagagcaaatggaatagaataaaagttatataccaaaaatagaaaatgctctactgataatgtctttagggacctaaaatggactgtgatgttatagattgtagactcactatttatcctgtcttccttttatgttcatctgcttagtctcattgtgcaggtggtgtttgatttcattttgaagtaaaatattcaacacattgtcctactcactcaatagtctgagaacttgggttcactcacaaaactgagttgggcttagtgaatgttccctttttatctcatagatcccggtatgcggaagtagatcaatatttgcacatcgtgatctagctggatctgcaatatagacaggtaaaggtaaacctagacagacatagatgtagacctgtctagctatcttgctctatctctagccactctgctgtccatccatcatctctctgtcttcatccatctctatctttatctctatccatccatctatcacctatctattcttatcattcttcatatctatcaagccgctatcttctataaaattatatttatctatctctatatccaactgtctttctctctatatatctcttcatcatctgtctccaccatctatgtctctatctctggctctctattattctgaatatctatagaccttctagctaatatatatctttatctatctctatcttttatccatctatttttatctatccctatgagtcattcaacctcatcaatctatatccatctctacctgtatgcatccatctatctatctgtctatccatctgtctatcccccatctacctgcctacctacctacctacctctctctctctctctagagggagggaaaacaattgtgtttcccttagtacaaaatatggggagaaagtcaccagcaagactatatgcaaacccttgatagaaggtatttgggcgatgggccaacgcatgtggtgagagaacatttcatattttgatttcacacacttcccttctgatgatctctcttaaggaggcatggctttggccatccgaacttagctgcaatggatattttggtggtctgtaggaggcagtcccttaaactgtttcacacctgtaaagatgttgccagatgccaatactgaagaatattcaaatggctgtgcaaactttaagcttttaaatatcttgtagaaatatacatgtataaacaggacaaaaattctggagtgtgtggactcatatacttgcaataagcatttctgggtgatgggattgctgatgcttactatatttcctatttagaaattttagacatccctttagatgtttccctgtctatgtttaaaataagaaactaaatggagaagaaaacagcatttgtactggaagcagaaacatttgcaggaatgtgtagaggcagtgagcatggattctatgcatcaatgccaggctccttgagtttccaacgtgtgtgtgtgtgtgtgtgtgtgtgtgtgtgtgtgtgtgtgtgtgtgtggagagagagagagagaaagagagagaggaagagaggagagactctgcatttggggatgtgggtaggcattgacttgggcttgagggtgcccagtcacacctgttttgtgacatgggctggcaggtccagttaaggggagattgaagtgccagggtcattggtgattccttctcacttttgttcggggtcctcagttgacacttgtgcttgacaacccagtactctgagttctctaaagaagagggcattaaacctgtacgttcatataccctcgtctaagaaaggttttgtacaacttttccctaaagtatgtatatctcatcatcattatacatttcatattacatctaccagtgcccgtgaacaaagacacacatacatgcatttattaagaaaataattattggcctatgaaacctgtaatttgaagtccacaatgcatgagctaaaatatgtaagtgagctatgatacccaatgttgcacagtaccaaatattgtacaatggctatagaaaacaacaacaggctagcagagtatttcgatgtggaaggtgggaagtgaaggattgacaaaagagttgcatcttcggtgcacgtttctataatatgggacatttcattaaataaagtttggaactagcagggaaacctcactgtacagacgttcacacaaatgaggtaggaacacgggcattcacaggacaatgtatccagttatgctcttaggttaggagctccagttgaagatgatatgtgcatgtgtgtgtgcacattggcgcatcggcaatgccttggaagcgggcacattatcatgtagactgagattctgtgacgtgatgtcctttcatatgtctgtctacacatctcatattctatgctaacccatttcatgttatttgagaatcagaaaaacacagtaacatgacaagactcacctgtcatgtttcctcattttatcaatctcgttgagcacatttcatttctctctctctctctctctctcacacacacacacagagagagagagagagagaggagagagagagagagagactgctaacatggaatccttctgtcttagggggatgctctcgggaaagcactagttcccaaggttctgaaatggaaaaagactagcatacgctaagtggcataacagggaaattgtttgagatgcaaaagaaggcagaaaacaaagatgacaactacgtgatgcctgagatgaagacgtcagttctgtttcaaaagggcatgcattcaagagttggggaggggaacaggataaatcacttgattggcttaatttcctatctgtgtttgtgtttccaggttgacattaggagtgcataggtcctgagcatctacacgcggtgccactgggtcgccagaagaacagcgcacttcaggggcacagagtggggttgaagggtctgcacaccagcgcttgcagtgtgagcagcaagagatccagctcacagaaccaaacctgctgcgatccatgtgacactgggtaagatttccccatttactaaacattcacttgcattcacctcacgctgacatttcacagtggaattttccttgcccatcgttgtacagacacttgttttcaggataagagtcactgatttggtgtcggcaggcaaaagtttaaaaccacggtagagaggtgcagatggcagccagtgaccgctgcctgcagcgatcctcacgaccgatggtagccagtaatcaccaggatgatcgccacgcagctctgggttctgggtgctcttgcacatgacatggtgccgacacccagcatctgcatgtgggagacctcctcgggcttcctgggaagcacaggtccatactagcaccctagaaataaaaacatgaagcatttccccaggtttccgcccaaggagcccaaaggcacagaatactcagtaagaaatgtggggtccctgctggtacacccacctccccatgcaggtgctcctcaagatggaattgttaaaattaggagaaggccttgggtttgctgtgtaataaagcttctgtggaccttctgtatgatcccaaatacttgccatctgtctatccctctgtctaagactcacttgtcacgtttccttattttatcaacctcactgagcagggtgcttcgcgtttcacgaaaggatgctttcctgatacatttccgctctccctttaccatgttgcagcatactccagaattgtccattggaaacacgagttcaagtgcctcagggagattcaggaggaggaacacagcccacccacactgcaccccctttgcagtctgaaggcaaaggatgctctgaagagtagcttggtttaggagagacctacggtagcagagggtgtggcaggcagacccctcggcctcccttagctaccttttcccagctcatcatggactcggagtacgtcctatgctcttggaaaggccgactatggccagcaaaggttttgtgcacacgtgggacttcaccaaaaacgaagcctgaaaaggcgatttctctagaagttcaaatcctcgcagtagatgaaaaaatcaaggtgaaaagcacagacgtgaagaccccaactaagtttgagatggaagacattgccgcctctgcagcagcacagacgaagctcggtgccccactcagagagaagatggggtacagaggaacccttcgggtggccctggagattctgaaagagagaacaaatctgggtggaggaaggaaaccacatgaactagagagcaccacaccctctcagctttctcaaaaggtgcccgaaaagccagccagttctgtccctcgtgaagatgactggagatgcaaaggcgacctaaggaggagtcttgggaagagggaaaacccaagctcaccgacggtcccttcagagagtaagcgtgccctgcgggatgacaggtcgcaggagcccacagccattgcccctactccaggcgccctgcccggggacaggtcaggggcgcccagggccattgcccctactccaggagccatgctcagtggcaggtcacgggcacgcagggccattgcccctacaccaagcgccctgcgaggttacaggtcttgggcgcacagggccattgcccctaccccaggctgcctgtacagtgacaggtcacgggcgcacagggccattgcccctgctcgaggcaccaagcatggtggcaggtcatgggcatgcaggtccattgcccccaaaccaggctccctgtgcggggacaggtcacaggcgagcagggccattgaccctaccttaggcgccaggcgcggtggcaggtcacgggcccacagagccattgcccctactccaggctccctgtgcggcaacaggtcacgggcttgcggagccattgcccttactccaggtgtcctgtgcggtgtcaggtcacgggtgccaaaggacattacccctactccaggcgccctgcgaggttacaagtcatgggtgtgcagggccattgcccctactccaggtgccctgcgcggagacaggtcagcagcacgcacggccattgtccgtactccaggtgcccttggcagggacaggtcacgggcacgcagcgccattgcttctactccagggaccctgcagggaaacaggtcatctgtgtccaaggccattgcccctgctccaggtgccctgcgtggagacaggtcagcagcgcgcacggcctttgtccctactccaggcgcccttcacagggacaggtcacgggcccgcagcgccattgcttctactccagggaccctgcggggaaacacgtcatctgcgtgcaaggccattgcccctactccaggtgccctgcgaggttacaagtcatgggcgcgcagggccattgcacctaacccaggtgcctggcgcggttacaggtcaacgacaggcaccgccattgcacctaatctgggcgccctgggcggcaacaggtcagcggcacgcacggacattgcccctactccaggcgccctgcgaggttacaggccacggtcccgcagggccattgcctctactccagccaccctgcgtggtgaaaagtcacgggcgcacaccagccttgcccccgccccaggtgctttgcgcggtgacggttcacgagcacgcagggccattgtccctactacatgcccattgtgcgagatatggtcacgggtgggcataggcattgcccctattgcagatgccctgcgccgtgacaggccaccagtgcgcagggccattgctcctactccaggcgccctgcgctgtgacaggtcacgagagctcacagccattgatcctactccaggagctctgtgcagtgacaggtcaggggcaagcagggccattgcccccactccaggcactttgtgcagtgaaaggtcccgggtgcgcagggccattgcccctactccatgcgcactgtgcgggaaggggtcacaggtgggcatgggcgttgcccctactccaggtgcactgcgcagggacaggtcacaggcaggcagggccattgcacctactccatccgcactgttcagggttgggtcacgggtgggcacaggcattgcccttcctgcaggtgccctgcaccgtgacaggtcaccggtgcgcagggccgttgctcccactccaggcaccctgcactgtgacgggtcacgaaaatgcacggccactggttctactccaggagccctgcccggcgacaggtcaggggtgagcaaggccactgcccctgctccaggcgccttgtgcagtgaaaggtcccgcgcacgcaggagcattgcccctactccatgtttactgtgcggggacaggtcatgggtgggtatgggcattgcacctactccaggcgccctgcttggtggcaaatcaaggaaatgcagggccattgctattactcccggcgccctgcgtggtggcaggtcacagaaacgcagggtcgttgctcctactccagaggccctgcacggtgacgggtcatggacttatatggccattgctcctactccaggtgccctgcacggtgacagctcaccagcccacacgtccattattccctctccaggcgccctgcatggtgacgggccaccagcgcacatggcctttccttctactccaggcaccctgcatggtgatgcctctcacgcacacatggccattgctcctactccaggcacgatgcgcggtgacagctcaacagcgcgcacggccactgccccatctccaggggccctgcgaggtgacaggtcatggaaacgcaaggccattgcttctactccaggtgccctgcatggtaacaggtctgacaggtcacggaaatgcaaggccattgcttctactccaggcaccctgcacgttgagaggtcaccagcactcagggccattgttccaactccaggcaccctgggccgtgacagctcaccagggcgcacgtccattattccttctccaggcgccctgcatggtgacaggtcaccagcacacctggacattgcttctactccaggcgccctgcacggtgacagctctcaggcacacacggccattgctcctactccaggcaccatgcgcggtgacagctcaacagctcgcatggccattgccccatctgcaggggccctgagaggtgacaggtcatggaaacgcaaggccattgcttctactccaggtgccctgcgtggtaacaggtctgacaggtcacggaaacgcaaagccattgcttctactccaggtgccctgctcggtaacaggtctgacaggtcacggaaacgcaaggccattgctcctactccaggtgccccgcgcattgacaggtcaccagcatgcagggccattgctcctactccaggcgccctgggtgatgacagctcaacggccattgcccctactccagggaccccgcgaggtgacagttcgccagcaaacacggccattgcttctactccaggcgccctgcacggtgacacctctcagacacacaaggccattgctcctactccaggtgacctgggcggtggcagctcatcagcgcacaaggccatcgctccttctccaggtgccctgcatggtgacaggtcaccagcacacacggccattgcttctactccaggagccctgcatggtgacagctcccaggtgcacacgaccattgctccaactccaggcgccctgcgcgatgacaagtcatggaaacgcaaggccattgctcccactccaggcaccctgcactgtgacagctcacgaacgtgcaccgcctttgctcctactccaggcgccctgcatgctgacaggtcaccagcgcaccaggacattactcttacttcaggcgccctgcactgtgacagctcaagagaaagcagggccgttgctcctattctaggcgccctgcaccgtgtcggctctcaggcacacaaggctattgcttctactccaggccctctgcgcggtgacagctcaccatttcacacagccattgcacctatgccaggggccctgcatggtaccaggtcatggaaacgcgaagccatttctcagactccaggcaccctgtgtggtgacagctcaggagaacgcatggccattgctcctactccaggcgccctgcacagtgacaggtcacagacacatacggccatcgatcctactccaagtgtcctgcgcagtgacagctcaccagcgtgcatggccattgatcctactccaggtgccctgggcagggacaggtcacaggcgctcatggccattgctcctactccagttggaatgcaagcacatgtgttgcaaagcccccgagcctgccaggattccctgacgctttcgcggcatgtttgtgagaaaaaggggaagaaaagggcaaacgcctcaactcttatgtccctgcctcccacagtaacggaggagggtgcatctctgcctccaggtctcaccagccctgcaccccccgctctgaaggaagagacacaggacagccgcccgaagaaggccctggctgcatccccggaaagttctcccttctcggggaacattcaggaccccggagagggtgcctggaagccaggctgggcaggtatggctgcatcctctgggtcccgtcagcacaggctgccttcttcactccggcttgccaatagaaaaaggaagcgtccaggtccagattttcagaggagacctcaaggacctcagacgcctggtgacgctaagcttgctaatcctgtcaccaccattcaaagggctggcggtaaacaggatgggcagccccccagccttgcttttccacaggagccacatcccatcgaaaggggaacgatggtctggttcaaatttcaagatcatccgttttggccagcagtggtcaagagtgtcagcaacacagacaagaccgcgagggtgctcctgcttgaggccaacctgcaccatggaaagcggggcattcaagttcctcttcgaaggctgaagcacctggattgtaaggagaaagagaaactgctgaagagagcccagaaggcctacaagcaaagcgtcaactggtgcttctcactgatctcccactacagagaaggactggtccggggttctttccggggctctttcctggactattatgccgcagacatcagctacccaatcaggagagccatccaagagggagacctgcagattgactttccaaaggtgaattatggcgacctggaagactgggaggaggagacctccctgggcgggaagaggccttgcaagaaaatcctcccggaccggatgagggcctcttgggaccgagacaaccagaagctcgtggacttcatcgtgaggagaaagggggccgacccccaccttctggacatcttgcaaggcaggaagcagtccaggtggctgaccgcgtttctgaagccacacagggatttgcactgcattgaaacatacctggaggatgacgatcagttggaagtcgtggccaagcatttacaagaaatctacaagcaaattgacaaggccaggctgactctgataagggatgacaaagtcaattttgttctggaagttcttctgccggaagccatgatttgtaccatcgccgcacttgatgggctggattacaaggcagcagaggagaagtacctgcgaggaccacctgtgcattaccgggagaaagagctgtttgacagaaatatcttaaagaaggcaagaagagaaccagcaaccacccatacagctaattagctcccgcctgcctcccccgcacccataccttcccagggagctgcctcctttctagaattaatgaggaagcctcctcccttccccaacgcgtgtaagtatgttctggatattcgagactttgggaatgtgaggaattcatttggggcccatctctcgcatgtgctggtggcacattcatcaccaggtcttcatcgcaaactcgtgaagagctattttgttaaacgattgcaaccccttgcgattccctcaacgtctttggatgtgtagttgtcccgataggtttgaaagacaagagcattgattttcataacgtgtcttttgactggacttggtactttcacttaggacctatattcttttacacaaaaagccactggtatcagcttttaaacaacaataatttttaaagcctaatgtatatttttatggaaacgtcagtgagacttttcattcttttggcgatacgtggatagaaaccatcagattcctctttcagataattcctgccttttccctgctaggcttgtttattttttgaaaagtagccccgagagttgaatcccatgagagagtcattttctcctatgttaacacgaccttccgatactttttcaaaaagcaaactgcaggccaaacatgaagttaccgaatggcttgcacgtagtccatatgtgcttgagtgaaatctcagtgtgcagtgagcgtcttgtcagcctcatgcaagattgtcgctctgcatttccctgaaattccacaccctccttcaacggctgaactgtttcctagaacaggcttcaggctgtcttcataactgacagtgatggatcttctccctctaactgtccgtcccctgtggagggcagctagagccatctccttcttggcctggcttctctccacctgtgtggctggcccaactgcttaggagcccgtctacctgcccgtaaactggagtaaagccagctccttgttctggatccagaatcccccaagacgtggccatttgtctcaatgtcaccaagcttcatcttccaacttattcacgggccggctccaacaggtcccaacaatctagacacaggctggtaagccattcccggctgctagaggcgccagggctgggagttggaaaaatgggtcacaggggcagccttcattccgctaagtggggccggcccttggtggaataatattaaacagatgcaattcagacctaagttgtgaagcccacagattgctaggctaacttgaaacaagatggtttttgaggataagtgttatggaaaagccagtttgtttttcaaacttgatgctaaaataaacgtgaaggccttcacatgaacctgagtccttttttagttcttagaggaagtcacctgttctcatgagaccatgttatgtgttcacatggccatgtgttggggcgacattggcagaggagctgtttggagtcaccttaaaaccactgtgtctcccaccttgaacttcagctgtgtcatgcttgagattgtccaaatccataggtggaaggtctaggaaatatatagacacacttccaaagcaataatagcttggaaattctgacgaaattttagaagagagccttccaagtggtgtatacatcagacccgacggaaccctctctagactctgcctgagtgtgaccaagactcctgggcacactgcctgggcagtccatgtgacatcctcatggccccggcaattatttggaaacagatcgtctccgtgctgtgtgtggacctcacacaccgagacaacacactttagttactccacaacactgtctccccgagtctaacatatcacctgagttcagctttctcatggagccatgtttatctctagcttctaatattactttcctaccccattcattcattcctgacctcatgctagatcgggagagcaagtgaggtgtggttgaaggctctgctctgaagaccgacttcaggtgacatagaaacagacgggaatgtggtgactcaggtgacaacctaatctttaaggtaacaaggatgcactgcttccctctgtcagtgagaaattctcaccagtgtcatgggccaacggcctgtttttgagagcacagccccaggttcacccaactatgtgaggtcataggtgcctgttggcttggggtgaagggaggagacctggtctctcttggatgtcactgacacctggggcatccactgaagagaggcagacatgcctcggacatgcatctattctcctcctccttgaatcagggtcactgaaaggcatccggggcacgtgtgtgggttgagggatatatagactctgagatcctttccagcctgagcaggtgctgcggcccctccatgattgccctcagctggacctccatcacaggtgcctgtgtgtttgatgacagagcccagcctgtcacccaccctggcccgctaggttaaggtgacctcctcttctccagtcagaaggaagactgctgcccatcaggccctgatcttaactgttgcttggcagagctgcacacacagagacggctcacaccacattcgtaggtctctatatccaagtaagcaactgatggggaaagaggggaaccctcagatttgtaagagtgatgcccatgagaattttgaatacctagaatctcctgaaccctcaccctggcattagcaaccacctaacccttgctaattggggagcaatccccttattcatggaggctctgtaaagacctcgtccaagggagctgccgtaaaggaagttgccttcgagcctgtaattccagcacactgagaggccgaagcaggagcatcgcttggatctaggagttggagaccagtctgggcaacatagtaagactctgtctccacaataataaacatttaaaaactacacaggcgtggtggtatgtgcctatagtcccagctactcggaaggctgaggcgggaggattgcttgagctcaggaggttgaggctgcagagaggtatgatggcaccctcgcactccagcctgggagacagagcaagacccagtctctaagaaaaaaaattgcttgtcttacctaacatccatcccgctaactttcatcgctctgacaagcgcgaagtttgaataggaaagatcacagcacagaagagaaatacggtttctgtttgggtgggaaatacctcatattcagataagctgcagaagctggctagttcgccttggcatgacctgggacagcataggtgggaatggattttgggcatgcggaaccagcaagacagcagacagaatacagttcaatataggggagagtgtatttacgtgggagcacggagctataaggtggggttccctgtcttggggctggcctcagatcctgctgggctggcagcttcacgtttggacaacagcctacagtaaatgacatggagttatgggaactgccttggcagaatattgaccaattggtgaaagggttgagcggagagcagtattagatgtgattcattatgtgagaccagtggccctacctgtgaatgttgtccccttcgagggctgagaagacactctaaaatgaggaatttgctagtggggtggccccggcatctttgagagcctctgctttgactcctctcaaaacaatggttggaagcaagcgacgccgccatggaactggcaggcaatgagaggattctcaaatggcagggtccagacggtgacacaaaattaccagggctcaggtgggcaccactgtcgtactgggcagcacaatcagggtggggtcaggctcatttgatgaacagggacctgtggcaacgttacagattgtagtatctcagggcctgcatgtaaggacagctgactggactattacttgatttttattaaaagaataacatgagctggcaagcagaaggctgatgttagcagctgccgtggaaaactgtggtcccccaccgagggtccagatctgtcagttcataggcccagagcttattgatggaagtggaggtcagaaacactcagccacacattctcccagaaaacctgtggctatttaccaacataaataatgcagttctgtctaaagttcttctaaccggggatccgatagttctttggacccatcccaagtttgtttccctcaggacctagttgtcagtgatgtactttggatgttgcatcatcttcatgttggttcaagcaacattacatagaaaggtacatatgggagcctactaagctgctccctctttacaatacaggaacaaagaagtaataccacttctatagtgaaaacgaagagaagacccaaatttctaaatcagaaatgaaagcaaggacattgctacttaccttacagggattaaaaaaaaagactctaagagtgtatcatgagcaattttacattaagaatgaatctagaggaaacagacaaattattagaagcacacaactaacaaactggctcataaacaaagagaaattctctatagacctataacaagtgaagagattggttttgttatcaaaaatctcagaacaaataaaagcccagcaccaagtggcttcaccagtaaactctaccacacctttaaagaagaattaacataactccttctcaaactcttccaaaaaataaaagaggaggggagtcttcccaactccttctatgaggccaacattaccatgacactaaaggaagaaaaagacaccataggaaaactacaggcaatgacccttatgaaaacaaagtttaaaaatcctcaaaaaaatgctagcaaatacaggaggctgaggcagggggatatcctgagcccaggagtttaagactgcagtaagctatgatggtaccactgcagtccagcctgggtgacggagttaaatgccatctccaaagaaaaaaaaagtaatagcaaacaaaattgggcagcatagtaacagggttatgcaccacgaccaagtgagatttattgcaagtgagatcagtgtgagggtggtccaacacgaaaatcagacaacgtaatacaccacattaataaaatgaaggaaacaaaccacgtgattatctcaaatggtgtggaaaaagcatctgagaaaatcaaacactctttcatgataaggacactcagaaaaataagaagagaatttcctaaacatgaaaagggtcattcatgaaaaatccacagctaaaatcacgctcgatggtgaaaaaataaaagctttctccctaagatcatgaccaagacaagatgttcactttcaccacttctagtcaatagtttacttgaagttgtagccaaagcaattaggcaaaaaaaaaaaagaaaagaaaagaaaaagaaacaaaagacatccaatttggaaaagaagaaatagaatgacctagacccatagatggcatgttcttatatatagaaactcccaaagaatccaccaaacaaagccatcagagctaatgacaaagtcagcaaagttataggataccagatcaatatgcaagatccatttgcatttccacacattatgaacaatttgaataggaaattaagaaaacacttctgtttacgatagccttaaagagaacaaaatactcaggaataaatttagccagggagatgtacactgaaaaccacaaaacactattgaaagaaataaaagacctaaacaaatggaaagccatactgtgtccatggactggaagatgtaatgttgctataatataaaattgttattgtttagggagatgaaaatactcccccaatttacctacttattccatgcaatccctctcaaaatcccaacagccctttgcagaaatggaaaagcagaccccaaattcctatgggattgcaagggactctgaaaccaaaacaatcttggaaacaaacaacaaagttggaggactcgcacttcccagtttcaaaacttactatgaggctatggcagtcaagacagtgtggtactgccacaaatctaggcatacaaatcaatggcatagaattgagagtgcagaaataaacacctccatgtttgatcattgattttcagtaaggctggcaaggctacccagtggggcaaagggtttaggtgtgtgatgagcaataaggtttcagagcaagccactgggcagggcaatgacattcagtggaagcctgtctacatttggtagccactgtcttgagtaggcaccctcctgaggctgcaggggaggaataggtctcctccttgaactgaagtgaagtccacgcatcctccagatgggacagcctcccagtctcattttggagaagcccaacagagctcagcatcctgttgctgagagccccgtgtcctgccacagacggccccccagccttgccgcccgccaacattcctggaaactcctttctgtacctcccttgcatgctgtcatggaaacaggacttccccacccccacccccggataccgcatcctctgagccctttccagcagggctattcttgtccaccctccttggagcacagggcctggaggtggcataggtgacctccttgcttctcacagtggcttccacatcattctccctcaatcctccctgaaaaatacccagtccctttgaagtgcatgctctcagactacactgctaggattaccagatttagcaaataaaaacactggaagcccagttaaattcaaacatcccattaaggatggctatcttgagtagaaggggtcccatgcatttccaaatttaactgggcatgaccactgcccctcctcacgcaggccaggctcctcagcccagagcatggatggctcttgcccgtctccttacggttgtactcacctagttcagcctccactttgcagatgcaatgaaacattcaggacgtgcaccagagttgaaaatgggacccactttttgtccagtcctgtgttttgagccatctatcgggatgctgtctgtgaactggagcccagtcagtataactcaaccattccttctttttcaaaccatgtaaatcatagagacctcccttctcccggcccttgaccccatcaacagcagaaagcgatacatccaactggctgtccacctcttccaggagaaggttcaggctaagatcattgtatgttagatacccaggcgtcatagaaacccaacacccccagcctgttcttcatcacccagactcttttctgcataaagcaccgcacgtgctgcccttaatctggctgagattcccactgccccttgctcatgcgtgtgctgggaaatgctagagcctgccagccacaaacgcctctatcgtcaccttccactgcgcccttcacctgcctccatgccttgactgtgtcgtccccactgcagctctcttgggcccactaatggctagagcagcctaagtggcttctgaaggggaggggaaggctggggggtggtgggggctggacggtgaagctgcagaggtcagaagggcctgggggcagagagggagagagacggcgggaaggagaagcaagtgccacactcccctgcctgcaggtgggccccatggtgacttgggcccccagcaggcctagtgacaaaaggccttccagggctcttggataaacctgctcaggggtcgggggtgcggagggtcaaggagacctcggggaggtgggggaggcctgtttctctcatttgttaccaaggaggggcccctggcttgaacgagcccttgctccaggagacacgcacgtggtgagtggggctggtgggccagtgtcttcacagacatctcagggtggagtcagcccctgtgccagccaccaggcacacagagaggtaggggccaatgcccccactatccaggagcccacagtctcccagaggagacgcaagggagggctcatcatcaccctgaaggtctaaaggcgctgaaacagaccggacccaattaactctcaaatcttccctccaggacaaaggcccccacagagcagaaacttctgggaatagaagacaagtaaagcaagacaggcacaataggggcaaagaaaagagaaagtccgaatcacaatggagagggagaacaaacggagaacgtacaatggaaggtaaacagacagatggtcacagttctcacagtcaccagaagagagtgcccttcatacgcgaaatcagaaaacctagcctctcccacccttccacaagtgcagaaggactgatttcatgggaaaaccagttgacaagaggatcaaaggcaaatttcgtacaaagttactaaaagaaagaagagaataaggagcggaataacatccctccaagcccaagcctgggcctgacggaggcgtcccttagcccagcacgtcctcagccttggggatcatgaacccctttgagaaccagaagggggaagggcccttccctggaaacagacatgtatgcacaagacccctagaagggtgccttctctggccgggcagtcacaggcaccctggccccatccatggtcccagctggagcctgacttccgaaggtgagctctatgttatttccatgatgatactttgtcattgtaataggacctggggaagaatcagagcaaaacaatcaatcactttgtttagtaaaataattttattttctatttcaaagttggggagagatttggttatttttatttttattttaaaaaagcaagcaaatattatgatggctcctcacaaaatgaaacataaaattacccagcaaccccacttttaggtaataccccccaaaattgaaagcagagtcaaaggggtttttgaacatccattttgacaacattttattattattattattattatttattattatttgagacaagctctcactctgttgcccaggcccaagtgcagtggtgtggtcatggctaattgcagcctccacctcctgggctcaggtgatccccctgcctcagcctctcaagtagctgggactacaggcacgcatcaccacacctagctacccgttttattttttgcagagaggatgtctcagtatgttgcccaggctggtcttgagctcctgggctcaagggatcctcccaccccagcctcccacagtgctgggatgacaggcgtgagccaccgcacctggccgatagcagcactattcgcagtagccaaaaggtgaaagcagcccaagctcccatccatggatggatacgcaaacgtgctccacgcacatgacagaatacgattcagccttcgaaaggcaggaaattctgagccaagctacaaggtggatgacccttgaggacattatgctaagtgaagtcggccagatacaaaaagacaaatactgtaagattccacttccatgaggcccttagagtagtcaaattcagagacaggaagtagaatggtggttgccttgggctgaggggtgcggggagttggtgctgaacagggacagggcttcagtttgggaggacaaagatctccggtgacagatggtggtgatggctgcacagcaccgtgaatgtgctgaacgcctcctaactgtccatttcaaaatggttaaagtggtatattaaagtggtatgctttatgtgatgtgtattttaccacgattaaaattgtagaaaggaaaagaaaagctggccaagcatcttagtttcggcacactgacactccatgtcacagccagaacgagggacttccaccaccgggattcgagaacctgaagacgctggccaccagagagagtcaccaggcgccaatgtctgtggcccgcggcccatcccagaggcgaggctctcggtatccagggccggctcgacctgtggcccgcagccagcctcctgcaaccacagggaggaaccaagagaggcgggagggccttcggaaataggcacgtcactgacctgctagaagttacttgagcacatccattccttggcaatcacggaaaagaaagtattttcttctagggtacccagaatgctcagctgagctatctgacctgacctggcccggctcacggccccagcatgtggatttggaacctacaagcacactggctctgttggcagccccaactcgcacacccagtctcgtctccccggcggggctcaccgctgctgcgtgggcctgtggggactcctctctgctctcccactggctgcagcgttcataagtcccccttcccccaacacggtgctcggtgctgagtaaaaatatacacacgcacgtggagcccaaaaccatatttgtcctagggattggctcatgctagatgggaagaataatcggagtgtgcacacgcaggagcatttgctatttcttttccagtctacgatgaagcaggaacgtaaactgagttactctagtcggccacaacgtggagttctggtgtttatctagctgaaagcctgtgtaatgtgagcacagagacacattcattcattcaagaagcactttgggagcacccacgctacgccaataagacggctgggagccgggattacaaaacacccccggtcaaggtgtgccacaaaagatgacagccccccagaggggatcccgaaagcagcagctggaagtcagtgggatgtgtgctaagatcccaaacgggggaagccacgggactacaggaggcaacggcaagggtgcctgcccctaccgagtgggcagggaaggcgtcccgtgggaaccgtttaagcgagaaaggcactacgagtaggagttacccaggctgaggacaggggtgcgcaggcaataccaggcagggacaagcacttccagacaaaaaggagcagagtcactggaaggcgggggatggcaaacattttctgggcagggccggagggtcaatattttcagctttgccacctcaactctgcggtcgtggcacgaaagccaccccgcaggcacaacgcagagatgaaggatcatggcgacttgattcctggacagtggcatctgcatttcccatcactcttgcctgtcctgagataataccactctccctttggtcatttaactactctccccgggctggacacttggaactttcccagtcttatgctgtcactagctatgctgcactgaagaagatcttaaacatatttctttcatctatgagagggttcatctgtcggctggatattcctcccacacagtggagggatcaaaggttctgtgcatctgaatttttaatggatcttgccaaactgccctccatgggagttgtgccaatgtctactcctgccaacaaccagtgggggcatctatgtcccatcaggctcaccaacactgtgtgatctgacatttagaatttagcccattgaatcagtaaaaacaaacaaaccaacaaaccaaaagggataatctcagtgtcttttgatgtgcatgtctggggatgtgcatcttttcataggttcaagagcctcttgtatttcctttcttgttcactgtctgttcacgtcctttacccatttttcccactgggtgcttcatccttttctctgtaacagttccttgcgtattgagataggagttggagacagttttccctagtgtgtcatttgtcctttggctttgctgatcgtattagtctgttctcacattgctataaagaaatgcctgagacgactgggtaatttatagagaaaagaggtttaattggctcacggttccgcaggctgtacaggaagcatggtgttggcatctactctgcttctggggaggcctcaggaagcttgcaatcatggcagaaggcaaagggggagcaggcacgtcacctggccagagcgggagcaagagagagagtgtgaggtgccacacactttaaaacagcccgatctcacaagaactcctcactatcacgaggacagcaccagggggatggtgttaaaccattcatggaaaatccacccccaggatccaatcacctcccaccaggccccacctccaataccgcagatgataattcaataggagatctgggaggggacacagatccaaactacatcactgatgatggatcgctttgccactcacaaggtttggctcggctttgtacctttctgttacagaagagactttctaaatctcatgaaggaacaggtgtcagcggtggcagagatccgcgttaccccgagttactggtggcgaatctgtacgcgtctgcagtaactgcaattctcgcctcctcagaagaaagcattcaactgaggggtatagggcagaaagggggaccgaggtgagttccagagcaggagtgtaagtttattaaaaaaaggttttagaataggaaagaacccttggaagagatccaagtgggcacctgaaggtcaaagagaaagagaaaaaagggcctttccccttgaccctgggactttataggctcacatctttccgatgattcttcccttagggtgggctttctgcacgcaccgtgtcctccttacccttgagaactgcacctgcccagtgtgttgtgggatttgtacgcatgcccacctcaggctttttccctttttccagtggcgtgtgtccgcgagatcataaaatacttcagcatttttgtctcttaatgtgcgtgcccaggaagttgcttctcccttggggcctgcctttaatcaacactttaatgttaacaggtgcggaccgtcaggaactggcctctgtctggcgccggcactacttttagagaggcgatgcgataactgctgaaccatcacccgacatttccagtgggtagggggaagagccctcacctgccccactcatggctagctacctgtataacacagggacttgatcctaaaggcagtggagggctgacacggaggtgttttcagcaaggaagtgacccggtcatgggtccatgttatttatgaagctcattctggctacagggtggtggagggactggaaagggactgaaatggccccaaagagaccagctggtggccaggaccagggtgtggaagttgcggcgggccaagaagcatttctgagtggagctatgtgatggggagagggtgccgtccaggagcaggccaggctttgggcttgtccagctgggtcactgtgtggatgtccatgatgaagccatggaatgtagaaagaagagcacggcttccttttccttccttcttttattggggtgcaggggagacaatgagttctgcatcctacagggacccttttcttaaaccccacaaggagctgagtgccacacctctgtgctccagggcaatggcctgtgcagtgcctgtttccctcaagagcctcccccaggggcagggacgatgctttagccgtaatgtggatccctagtgcctagcacagtgccaggcactgaaaaaatactaaaagaataatgcttacaccagaggaagagagctcccgagcggaagataaatctaagtcattaacaacagctcagagggcaggatccatgctctggaggtggcaccataggcccacaggcggggctgggcctggagaatgaatgaatggataagtgaatgaatgaggtgccaggcagagaggaggcctttctccaccccctgccagtgtctctcaggcttccatccttccttggccctgctcttctcaacaggccatgtcccaccctcagctccaaaggccacttgcccgttctgtgttcaaacttgaaggtcagtggtccacggaaaggaatggtgggcggcgcatgggtggggggcaggagaagaagggccatagaacctcccttattccaacaccactttctgagtgtctagtttgtggatgtttcatgggatagtaagtagcatattacagcagtgacgtgtgtgatttagacatatctaggtgtgcacttctttggtggggaggtgtctgttgggtcctctagggatgccaaaagagccttaggagtgccagtgtctgccagcccacagcgggagatggaagcaaagacggccccttggaggggccccgtggtgagcagagataagaggtgcaggcagacaggaggagtttggctgggttggggggatgttttgtggcggcagcatcattgatataggatgagctgggcaaggaggagctgggcaaggaggagctgccaccacacagaagcagttacaaatccgtaagctctgcctcaagcagcagtagactcagcacccgtttcctgagcgagcacaatgtggccagcagagttcaagaaggagagtggcatggcccctgccccaggaggcttgcagcagggggtacccctctaaatacatctgcctctgtgtgcttccctcggctgccgtaagaaagcaccacaaaccagttgacccaatcactccacagaaactgattctgtcccagttctggaggccagaagtctaaaaccaagctgtctgcagggccgtgctccctgggaaggctccaggggatgatccttcctcgtctctcccagcttccagtggccccaggtgtcccttggcctgtggcctcctggccctaatctccacctccttcttcatgtggctttctcccctgggtctccatgtctgcgtttctcctctgtttggttcctataaggacatttgtgattggatttaaggcccactcgggtaatgtaggatcatctcctctcaaaatgctcaacttcatgatctctgcaaagaccccttttccaaataaggtcacatttgcaagatcagaaggtgaggatgaggccatgtgtgtttttttttttgggggggggaggtgcaggtggggggggcacaattcagccatgaccctggccctgtctcagcttgtgcatggccgtgcttctcaggggttgccctctgccttggagtccagcccgagaggcggcgggaggctttgccacactcgctgcatctggaggatttccctcggctagaaagaatgtgatggggatgaagagctgactgcctggaagtcttcgcatgctcagtgcccttgtgggcacctcctgggtctgaactctctgatatccctgccctgccttacagttctggaggtcagaagtccaaaacgggaagttctaagggacgaatccttttccttgccactgcagggccagtgagcacagaagtcagggagagcagagaggagagctcctggcccagattagcagagcctggcctttgcctaggggcccccccagaatcaaacagggagccataaggatgccagaagtatctcctcacctcatctgcaggacccagcccttgagcagggtgcacaagactcagctcgttactgcctgtggtggcacagtaacagcccccaaagatgttcgtggcctaacccctgggagctgcacatatgttaccttacatgacaatagcgattgggcagatgtgagatgggtggggagattatcctggattggccaggtctttacacttgaaggacaagggtccttaagtgagggagagggaggaagaagagtcagtgtcagaatgatgccgccagagaaggactcaaccggatgttgctggctttgaagacggaaggagccaagagccaaggaattcaggcagcctcaaggtgacaggaaaggcaaggaaaagggttcttcccctagaacttcctattttagacttctgacctccagaactgtaagacgatagatctgtgttgcttgaagcagcgggtttgtgataatttgttacggcagcaacggggaacgaaaacaccacctgcctgcaggtgcacatctgcagcacactgcgggggtgggggttgctttcactgtggtgaaatagacatcacattacatttactattttaaccactctaaagtgtacagctcagtgtcattaagtacatttgcaatgttgtgcaaccaccatctctacccagttccaaaaagaatttcatcatcctcacaaagactcctcctcccattagcagtcacgccccatttactcctcctcccagcccctggaaaccacaaatgcactttctgtctctatggatttacctctctgggcgtttcatagaaatggcttcctgttatatgtgaacctttgtgactgacttccttgtctttttttttttaattgtagtgaactacacataacacaagatttaccgttttaaccatgtgcacacacacacacatgcacacacagacacaactctagtgaatattgttaaccacgagtgtcatttcttgcttcctcatatcttagaaggtttcatatactgctttactttaagtacctgcccgcatgtcacttacatataaggtaagtattattgttcctgttttacaaatcgagagagagagagagagagacttagaaaggttatgtggcccaggaaaccagttactgagagattcttcaagattgcagtttgcctccctgggccacttaacccctgacctcaaatgattcgcctgccttggcctcccaaagtgctgggattacaggcatgagccactgtgcctagcctgtagttctctatcttgagagagatgaccctctgttgtgaatcacaacaggtgcaggaggcatgtggcaacatggaaaaagagaaatagaatagccaagaaactgatattcagaagatcatagaagagggctccagtttcatggttccaaagactccctgaatagccccatgacaattcaacaccaacatgatgaaaaccaactcatccctccaccatgtggtttctcccatagtccctgtctctgttggtggcaccttccaacccaagtgccaagctagaaacagtagggtaatctgtaacattttcctttgcactgccatccacatcctatcatcctcactatctccagtgatgggaggggcttccatgaagacctctgacatgcactggagacatattcccccttgtcttggggattaacatatggctccttgttacttatgcaaatttctgcagccagcttgaacttctcctcagaaaatgtgtttttcttttctattgcatcatcaggctgcgaattttccaaacttttatgctgtgtttcccttttaaaactgaatgcttttaacagcacccaagtcaccccttgaatgctttgctgcttagaaatttctttcagcagataccctaaatcatctccctcaagtccaaagttctacaaatctcttgggtagggcaaaatgccaccagtctctttgctaagatatagcaagagttacctttactccagttcccaacaagttcctcatctccatctgagaccaccccagcccagatttcattgtccatatcattatcagcattttggtcaaagccattcaacaagtctctaggaagttcccaactttcccacatttccctgtcttcttctgagccctccaaactgttccaacctctgcctgttacccagttccaaagtcacttccacatttttggttatctttacagcagcaccccactctaccagtaccaatttactgtcttcatctattttcacactgttaatacagacatacctgagactgggtaatttataaagaagaagtttaatggactcacagttccatgtaggtggggaggcctcacaatcacagcagaaggtgaaaggcacatcttacacggtggcaggcaagaaagaatgaaagatccaagtgaaaggggtttccccttataaaaccatcagatctcgtgagacttattcactaccacgagaacacaatggggaaaactgaccccatgattcaattttctcccaaccaggttcctcccacagcacataagtggaacacaacacttaaatggaagctacaatttaagatgagatttgggtggggacacagccaaaccatatcagcatcccatgttcatgaactggaagaaacacagacaagtcagtgtagattcttttaattgccccaaggaacctcccagaatttaccttctcccacactaatcctattttccacccaaccactgaggcttcagaaaagcaaatcttgttgacatacaactgcttcaaagccttccaaacatctacactgcctatgggacacaagtcccaaatcttgaatatagtctccttaattctttgtgatttggaaccgcactcctccacagctgtccccggaagccaccatgctctgtcactcctgtagacctctgaaagcaagctatccttcatcctatccatttatttcacaaagctctactgagtgcctactatgtgacaggcactgtgctaggtaccatcctaaagagtttaccagcttctgatgtaggtagtgctctacaaaggacaggatgccaagggggcacagaacaagaaggcagtggttggagatgggaaaacaggaaattcaggagagctatgtggaccctggtaaaagcaggtgggatgaaaaagatcccaggtagtgtccaagagagagtttttcaagacaaataagagaaatttgtaggctgtaagtgggtgattcacttctccacagacataaatacatccatgggacctgccagggattgtagataagatgcggaaacactaggtgattacgaagtgtgggagggaagagagtcaaccattgaatggggtggatgtggagaaaagcttaaaggaaacatcctgtccctggcatgtgttacaccagaattgaacatgggggcatgaggagggaaatcgtgtccacttgggaaagttctttaagggtgttaaagaaatgacaccttctaaaactgcagcaacttggttggcccacctcccaccccataaacgtgtcaggatggtcctgtgtgatgtctaagtcccctccccagcactaatgtaggcctagggtgtgttttgctgacagaacagaccctgggtgtgtggctactcattgtccaggtgaggagtatagaaaaggaggccatggggcctggtatagaccaatgggagggtttgacatggcaatggtgacagggaaaccaaaagcaacttgcactgttaccagacaaccaaccctcaacaccagaaaggaaagaagaggaacacccctacaagccaggtccatagatagggtcaaggtaagacaacccaagccaagctcttcctctacttccccattgacttccctcccacaagactccttcctgtccttacctggaccaaaccttcttcagcctacacccgatctcataaaattttcctgattaccagagtaattcaggattgttaaaaacatgttcaaaccccacagaagcacacaaagttgaaagtaaccatcttctgtcacctcagcaataactccaatcaattattgggtacaggtcattcaaaagttccttttctctttgtacctgtattaatgctggcacacagtgcctctagctaggtctacagctttcatccctgatacagcattagctgtcatcccacacaggaatttggtttacaaaacccttatttatctaccctttgcccttcctttttacactggatgtcactgaaattctgcttcctgagatactggtaaacagcagcatgtatatacaatttgagtcaaacaactgtggcactgtgttacctccatgtaaccctaggtcttgcaaaagtctgaagaacacagctctggtctggatagtctttcaggtcacgtgctctagcctactccttcttaggtcccccgtgtgcggtgccatagatatagtgttacaatgaggtgttgactttctgctacatactctagggtgtggccaagcaaccactgataaggagattagtatggatagaaggaatccaggtactattcatcatgacaatgggagaatgaccacaaaggcatttcagagattttcaaagctgcccctccaatcacaggcccagaggaccagggcctcaattgagggcagaatggtttaaagcaaggggccccgggctcctgtggaacctcagggctcactgtccagaggtgcctcaggtctctgctccccaaattccagtgtggtgcacctaagccaccccagctgtggctgaagcatgtccatgtatgactcagtccatcactctagaggggacaagtaatgagccttgacagtgttgacatggaagtgactctgcaggcacacacagcataagagttgtggaggcatgacgtcctccacctagattccatagaatgtctcaaacagccttggggctcaggcagggaccagccaaacacatggaaccaccatagagagcccccactaaggcaaagcctaatggagctgtggaagtggggtcacccctgagatctcagaactgtagagccaccagagtgcaactccggcttaggaaaaccacaggcatgcaacttcaatacatgagagctgaaacatgctctgttcccagcaaagtcatgggaacagggctgctcagaaccttggagactgcacccccacatcagtgtgtccggaaagtgggacatggagtcaaagaatattattttcaagccttaagatttatggttgttttccctgttgggttttggacttgcttgtggcctattactcctttcttcactcctatttctcccttttgggatgggaatgtttatcctatgccagtcctaccattgtatattggaagtacataatttgcttgatttcacaggctcatacctggagagaaatttacctaaggatgaagcataccttaagtctcatctatattgtcaggcctctgagcccaagctaagccatcataacccctgtgacctgcacatatacatccagatggcctggagcaactgaagaaccacaaaacaagtgaaacagtcagttcctgccttaactgatgacattccaccattgtgatttgttcctgccccaccttaactaatcaattgaccttgtgacattcctcccctggacaatgagtctcaggagctccccactgagcaccttgtgaccccctcccctgctaacaatagataaacacctttaactgtaattttccactgcctacccaagtcctttaagactgcccctctcctatcttcctttgctgactcctttctcggactcagcccacttgcaccaaagtgaataaacagcctcattgctcacacaaagcctgtttggtggtctgttcacatggacgtgtgtaacatttggtgccgaaaaacccggaacagggggattcctttgggagaccagtcccctgtccttgccctcactccatgaggagatccacctatgacctccagtcctcagacaagccccaggaacatctcaccaatttcaaattgggtaagtggtctcttcactctcttctccagcctctcttgctacccttcaatctccttgtccttccaattccagttctttttcctctctagtagagacaaaggagacacattttatctgtgaattcagaaaccccgacgtcggtcacagatttgggaagacagtcgtcccttggtgtctgatcttcacagggacacctgccttgatcattcacccacactcccctcgtggcaagccaattatggggatgcctgctttggctgatcacccacattacagcccaggactcagccagggacacctaatgaaagcctggtagctgctcacttccccttctctacatctctacctttctcttcaatttcacctccttcactatgggcaactttacaccctccattcctccctcttcccccttagcctgtgtacttaaaaacttaaaacctcttaaactaacacctgatctaaaacccaaaagtcttattttcttctgcaatgccgcttggccccaatataaacttgacaatggttccaaatggccagaaaatgtaactttcgatttctccatcctacaaaacctagataatttttgtgaaaaattgggcaaattgtctgaggtgccttacgtccaaacattttttacacttcgctccctccctagtctctgctcccagtgcgacttgtctcagattttccttctttctctcccgtctgctccttcagtctccaccccaagctcagagtcctctgaatcctccttttccactgacccttctgacctctctcctcctcccccggccgctcctcgccaggctgaatcgggtcccaattcttccgcagcctctgctcccccaccctataaccctgctattaccccccctcctcacactcagtcttgcttacagtttcattccccgactagctctcccccacctgcccaacaatttcctcctagagaggtggctggagctaaaggcatagtcagggtacatgtgactttttctttatctgacctctcccaaataagttagcgtttaggatctttttcatcaaatataaaaacccagcccagttcatggcccgtttggcaacaacccttagattctttaccaccctagacccagagggaccagaaggccgccttatccttaatatgcattttatcacccaatccactcctgacattaaaaaaaaaaaacccaaaagtttgattctggccctcaaaccccacaacaggatttaatcaaccttgccttcaaggtgttcaataacagagaagaagctgccaagcagcaacttatctctgagttacaactacttgcctccgctgtaagacaacccacaaccacgtctccagcatacaaaaccttcagaacatccaagccacggctcccaggggctccttcaaaacctcctcgtggaccttgcttcaaatgccaaaagcctggccactgggcctcggaatgcccacagcccaagattcctcctaagacatgccctgtctgtgtgggcccccactggaaatcagactgtccaactcacatcgccgccactcctaaagctcctggagctcaaacccaatattccttggctgactctttcccagatctcctcagcttagtggctgaatactgatgctgccccatcatctcagaagccccctggaccatcacagacgccaagcttcaggtaactcttacagtggagggtaagtccgtcccctgtttaattgatacaggggctactcactccacattaccttcttttcaagggcctgtttcccttgccccccataactgttgtgggtattgacagccaagattcaaaaccccttaaaactcccccactctggtgccaacttggacaacattattttatgcactctttttttagttacgcccacctgccagtttccttattaggctgagatattttaaccaaattatctgcttccctgactattcctgggctacagccacacctcattgctgcacttttacccaattcaaggcctctttcacatcctcctcttgtatcttcccaccttaatccacaaatatgagatacctctactcctaccttggcaaccaatcatgcacccctcgtcatcccactaaaacctaaccacccttaccctgctcagtgccaatatcccatcccacagcaggctttaaaagggttaaagcctgttatcacccacctgttacaacatggcctcttaaagcctacaaattctccttacaactcccctatcctacccgtccagaaaccggacaagtcttacatgttggtttaggatcttcgccttattaatcaaatcgtccttcccatccatcctatagtgccaaacccgcacaccctcctatcttcaatacccccttccacaactcactattctattatcgacctcaaaggtgccttctttactatccccttgcatccctcctcccagcctcttttcgcctttacttggactgaccctgacacccaccaatcccaacaactcacctggattgttctgccccagggcttcagggacagcccacactactttggtcaggccctttctcatgatctgctttctttttgcccatctgcctcccaccttattcaatatattgctgatcttcttctttgcagcccctcttaccaatcttcccagcaggacactattctgcttcttcaacatctctactcaaaggggtaccgagtatccccctccaaggcacaaatttcttcccctagcattacctatctcagtataatcctccatcaacatacacacacccttcctgaagacattgttcagttcatctcccagaccccaatccccaccaccaaacaacaactcctttccttcttaggcattgttgaatatttccaactctggataccaggctttgctatcttaaccaaaccactttacaagctcacaaagggtaatttaactgatcccatagaccctaagtctttaccccattattcctttcactctctcagaaaggccctggagacagctcccacactagcactccccaactcatcccatcctttttccttacacacagctgaaatacaaggctgtgctgctggagtcctcacacaggagccaggcccacgacctgttgtctttctatcaaaacaacttgacctcacagttctgggctggccctcatgtctgcgtgtggtgacagctgccactttaatacttctagaggccttcaaaatcacaggctatgctccacttaccctttacagttctcacaaccttcaagcattaatatcctcctcacaccttttacatttattgtctgcccctcaactcctccagctatattcactctttgttgaaactccaacagtaactattacacatgggcctgatttcaacccagcttctcacttagcacccaaaacaagtcctgaaccacatgactgtatttccctaatacacttagcatcttccccttttcctcatatttctattcttccaattccaaacccagaccatacttggtttatcgatggcagttcttctaaactcaatcaattttcaccagctaaagcgagatatgctgtcatgtcccacacctctattatcgaagctgctgcacttcctccctccaccacttcccaacaagctgaactgattgctttaacttgtgtgctctctctcactaaaggaatgcacattaacatttatgctgactccaaatatgctttccacatcctccataaccatgctgccatctgggccaaaaaaggcttccttgccacataaggctcttccattatcaatgcctccctcataaaggccctccttaaggctgctctcctgccggccaaggctagagtcattcattttaaaggacaccagaaacctactgatcttattgcaaaaggaaatgcttatgccaacaggacagcaaaagaaacagccaatgtttccacacctgctaatattccagcccccactccagaggaccagtatttttctttctcctctatcactcccacctactctggttctgaaaacctcctctaccagtcttttccaactcagggcaagtggtccttcgagcatggaaaattcattcttcctgcctcacaagctcagtccattctttcttcccttcatgaccacttccatgtgggatacaagcctggctatcctcctgcagcccctcatctccttcccttcatggaaatccatccttaagaccatcacctctcaatgctctgtctgccataccaccagcctccaaggctttctcaggcctcctccttttcctatgcatcaggctcatggatttactctgacacaagattggcagattgagtttactcatatgccctgtgtccgtaaatttaagtatctcctggtttgggtcaacaccttcaccgggtaggtcgaggcctttcccagtagctcagaaaaggctactgcagtcttctcttcccttctaatagatataattccccgattttgcctccctacttctgtgcaatctgacaatggtctggcttttattagtcaaatcacccaagcaatttctcaggctcttggtattcagtggaatcttcataccccttaccatcttcaatcttcaggaaaggtagaatggactaatggccttttaaaaacacacctcaccaagctcagcctccaacttaaaaaggactggacagtacttctaccacttgcccttctcagaattagagcctgcccttaagatgctacagggtacagtccatttaaacttttatgtggacgtactttcttgctcagccccaaacttttccagacaccagccctctaggtgactatcttccagtccttcagcaggctagacaggaaattcgccagactgctaatcttctcttgcctgctccacattcccagccatatgaagacatctcttttagtacaccctctcacctcttcactttgcacttccagttttgccttacacaaggtctctttttcctctgtggctcatccacctacatgtgtttacctgttaattggacaggcgcatgcacaccagttttccttactcccaaaattcaatttgcaaatgggaccgaacagcttcctgttcccttcatgacactgacacaacaaaaaagggttattccactaattcccttgcttgtcggtttaggactttctgcctccactattgctcttggaactggagtagcaggcatttcaacctctgtcacaaccttccatagcctctctaatgacttctctgctagcatcacagacatatcacaaactttatcagtccttcaggcccaggttgactctttagctgtggttgtcctccaaaacagctgagacctcgacttactgctaaaaaaggaggactctgtatatttttaaatgaagcgtttttttgttttgttttgttttgttttgttttacctaaatcaaactggcctggtatatgacaacatagaaaaactcaaggatagagcccaagaactcaccaaccaagcaaataattacactgaacccccttgggcactctctaattggatgtccttggtcctcccaattcttcgtcctctaatacctgtttttctccttctcttattcagaccttgtgtcttccgtttagtttctcagttcatacaaaacagcatccaggccatcaccaatcattctatatgacaaatgctccttctaacaaccccacaatatcaccccttaccccaaaatctttcttcagtttaatctctcccactttaggttcccgcgccacccctaatcccactcgaagcagccctgagaaacattgcccattatctctccataccacccccaaaagttttcacagccccaacacttcaccactattttgttttgtttttcttattaatataagaagacaggaatgtcaggcctctgagcccaagctaagccatcataacgcctgtgacctgcacatatacatccagatggcctggagcaactgaagaaccacaaaacaagtgaaacagccagttcctgccttaactgatgacattccaccatagtgatttgttcctgctccaacctaattaatcaatcgaccttgtgacattcctcccctagacaatgagtttcaggagctccccaccgagcaccttgtgaccccctcccctgctaacaatagataaccacctttaactgtaattttccactgcctacccaagtcctataagactgcccctctcccatctaccttcactgactcctttctcggactcagcccacttgcacccaagtgaataaacagcctcattgttcacacaaagactgtttgatggtctcttcacacagatgtgtgtaacataaatctgatttggatgagattctgaattttagacttttgagttgatgttagcataagttaaatctttggggaatattgggatgaaatgaatgtattctgtatgtgagaaggacattaattttgtgggccagaggggcaatgctatggactgaatgtgttccccaaagctcatgtgttgcatataatccccactgcaacagcgttgggagataggaacttttggacaatatttaagtcatgagagcctaatggattaatgccattaaataaaaagggtttgttagagtgggtttgtgctgttctgttcttctgacatgtgaggacacagcatttgtccccttttgccctcatgccttccactatatgctgatgcagcaagaaggccctcacaagatgctggtgccttgagcttggacttcctagcctccagaactgtgagaaataaatttctgttctttgcaaattacctagccttaggcattttgttatagcagcacaaaacagactatgacaataacttatagtttgcatcgtgttactaacttcaagattgttttattataattcagttttgcaccacattttggcaagaaaatttaactttggcaaggagataggaaatccctctccacttctcctcaggctaggaaatgtcccacacatagttctaaagcccacagctcccagtatttactgtctaagctgcctcactggtgacaacattcaattattacaaggcaatccctaaaaggactatgtgtcttctgaagtaagctaaatcagtagcaggtgtatgacaggcacagctggtgaaggtaaggggaccaaggagcatttggaggagggccagaagtaggcagagctagagggagcatagtagaatgtgacaagtgtataccaggcaaaccgagcattttcaaaaaaaaagaaaaaagaaaaaagcctgcattcgtccaactcggtagagaggcacaagagaacgaagttgagggcttgtcttttgggatctctttcagggactgggtcagatgctgagtacacatttgcagaattcctcaaaataaggagacacagtcctattaatcagaagaagaaagaggaccaaacatgcagtcctgattctgatgggaggcaaagcaagcataacttcaagaagaagagtgacaaaaacaggagaaggcagaataatttggggggtaagagtctgaggaggaagtaaggataagctcctgctatggagtgactatttgtgtcctcccaattcatatgttaaaatgctatcccccaacctgatagtattaagaggtgtggcctctgagagattatcaggtcaggaaagtggagccctcatgaatgtgattagtgcccttacaagaagtggcaggagagagatctctctgtctttctgtcatgtgagaacacatcaagaagacagccagaaagtgggccctcaccagacaccggatctcctggcatctttatcttggacttcccagcctccagaactatgaaaaataaatctttttgttttttctttaagccacttaatctatggtaatttgttctagttgcctgagctaagatagctcctgagtgcaaatagaagggtatgctttagagaggaaactataaggagttggtgagtctagatgtccaagttaaaggcctatgatcctgtaggacccatgtcattaaaaagggattctaggaaggaaaaaaaaaaaagaaatggacaataaacacttggaaagagatttcttttccaactttttagaaataaaaaatcaattttccccctttcaaattggcagagattaaaaacacagtacatgctggtagggtatgatgagatatacattccaatgctctgctgtaaaagtatgaactggaaaaaactttttggtgagcaatttgtaatattggatcaagcaccttgaaaattcctattctgggatttattctagaaagagctgtgcagagagacataagtagaaagatgttcataacagtgtgagcagtcactgtgaaagggggaaattaaaaagtctgacaatagaaaaagattaaataaattatatatctacatgatgaaatagtccacagtcattgtagatcatgattttgaagaatttttaatgacatgtgaaaacagttatgatacaaaattaaacaaaaattaatatacaaaattatatacaagtacatagcatgatcttttctttatagttatatatataactatgcatacatatatacttatatatgtaagtactggaagggaatacatcaaaatattagttacttttctctaacaggtgattttatttgcttctttcttcttttctaaaatgaacacaagatactttatgattaaaacaaaccccataaacaagagacattatttccaaattaggaagaggagttctggtcttctccagcctgagggttaagacttctttgaagaattcaactccactcaaatattcctcattgccttgaacaggaaagcagatgaacgcttgttctgggatgagttggttaagctcagccttgaacaaagagcagggggcagggatgtgggaacagaaccccatggcagccctggagtatgcgttcaaatacaagaaaaggagtatgtcctaccagacaaacacacggaggcatctcatcttaattcttcaactgagatggtgggggaggagcagatgccactggccggtcacagaagcagatgggttaggacggtctagagcatgcagcacctgtgtggacacctgtgtgaactggtgagagaaagtacattggctgaggtgtagctatgagcctccatagtcaagttgaatgggtttggttcctggctcagccacttacttgctgtgtgaactcagacaaactacttactctctcagagactcaatttcttcacctacttactctctcagagcctcaatttcttcacctgtagagtgaagataatgaaacttgctacgtaaggctctttggaagattaactgaattatatttgaaaagcagatatgattctgcatgcctggcacactgcaaatgctatgcaagtgtttgttgttgttattatttgttcccatgatcggacatactaacatgggacaacccaaaatacaaagagtgaaagctaagggctaaggagctcaatgctgaaaaggaggagaccctcaatctttcagaaaggcccgaaggaagtagaaacaacagagaaacccaagcgaagatgaggaaattaaatggatccccaccctaaaatcgtgttcatcttcctgacaggcctgatggattttgagaaaatgttgccagttaactttttaagaccaaatcaactttcttttacatctagttgaatgacccaggattgttgtgaatggaaaggaaataatgtattttagatatcctgcacttcatcatttgcccactcctaggaagctatccaaaggaaatagcctgacaagtttacaaatatgtagtataaggtcattcattgcagggttatttagaataatgaaaatctggaaacaatctaaatagctatcaatagtggacaggttaaatagattatgatatgttgatgcagcggaatactacacagtcactaaagagaatggatatttgcctatacctatatcttattaactgacatggaaagatgtccatgacacgtgattgaggacaaaataacaggcagaggaccacagcacacacaatagtgtttccacatctccacacatgatggtgcggagccagccttggaagaatgctcactcaaacgttgatagtgattgtccctgggaggtgggatttcaggacttctgtgttttctttgtgtctctgtattttttttaatttctgaaatgagcatatattatctttgtaataaagcgaatcttattgggtaaaaaaaaatccatttgttaaatgaatgaatgaatgtcttaaaaaacactagatacacaaatagttttctttgtcacccacttctcactcctttctttggggttaagctgccaccattaaacatgctgtacttgaacctgaatgtaaacgtcaatgtcctctgaaggagaatgcatggagagcatctcatcatgataaatggtgaatgtgggtaagtaccaaaggccaacaaaaagcccatgcaacatttagaatccttaaaatgttcattttttcttgtaagaactggaatttcaaaccataattcaatccagggcccccaaatggacaattttcactcttttatgaatgggtcaggtatgaacaatacaaagcaaatagaaaaccactctcaccagcagaacttgaaaaagcccatgcgctccttcactgactagaaaggtgttgacttacgaggccttcagtcactcacctggacaggagcctcacagcacttatctttccagcattcatggttcttctgctgactctaactggggtatcatctctggtttggaaattggaatctctggtttggggttttggggcgggggggaatggagacttagctctttgtgctgggacacagaggtgtcctggagttccactccagtcacttggtattcaagggtaaaggtcattctaggagagccgagaatgttccaagattatctccacagggctgaatgtgatttctgagaaagggtggaagaagggatagggatgagcatggcagcagggtctgggaaactgtcagctgcaaggaacaactggatttaccctcctggacagaagcagaatctcaggtcatctcggatggatccttataggagcacccctggcctagaagttcagaggactgggagaccaaaccctccgcagcagcttaagtaagtttatcaacaactccatttggcactgggctttcaaccagaaagagaaacataaataatctgattttggctgccaaggaaatggaaatctgacccttggctctacagccccagctcggagggtctatgggaaggaatgctgtccttaaccaggaggatcaggggcctgtagctcacaaacatcccattcctccctatagccttttgagcaaggcccaggtacaaccctctcctgacagaagtctaagggtacagctgtaaatatcacagactcctaaaaggcccaaaccattcctacttactctgagcctcctcagggagggctgtagttggcagcattgtaggaagaggtgaagatggacaggaggtggtccaaaagtattcaagggcccctctgcaccagttcaatgccaactgagcacgtgccaggctgagtgcttcactctgtgggagctataaaaaggagtagatacatctctgctcctgagaagaaagtcatttcattaggaagaaaagagttaaggcagattccaatgatcccctatgtgctagcataaggacatggggaattctttcagaggcaaaaaaaaaaaaacacctagcttgatttgtccttgggtgtatactgagtgctctaaccctagccctagttgtacactgagtgctccaaccacagtcttaggtacacatgagtattccaccccagccctaggtgtacacatgagtactccaaactcaaacctaggtgtacaatgagtactccaaccacaaccttaggtgtacactgaatgctccaaccacagtcctaggtgcacaatgagtgctctaacccaagccctgggtgtacactgagtgctccaaacccagccctgggtgtacactgagtactccagccccagccctaggtgtacactgagtgcaccaaccccagccatggttgtacactgagtgctccaaccccagccctgggtgtacactgagtgctccaaccacggccctaggtgcacaattagtgctataaccccagccctgggtgtacactcaatgctccaaccccagccctgggtctataccaaatgctccaaccccagccctaggtatacactgagtgctccaaccccagccctaggtgcacaatgagtgttccaatcgcagccctaggtgtacactgagtgctccagccacagccctaggtgtacaatgagtgcttcagcttcagtcctaggtgtatgctgagtactccaaccctagccctaagtgtattctgagtactccaattccagtcctctccaaccccagctctctacctgcttgagacatgtttgtccggtgaatgataaaagcaatttgagcaggaaagccctgagtacaaagtcaactggctaattttatggtacaggccgtatggtggagaaagaatgaagggagagaagtggggtggtgagatggtgattctgggtgaatgagagtagcttgatagaagaggtgctctcgtaaggagggtgagacttggataggatgcttcgtatctttggtccatggcaccagcagtccttgcagaagggattcggtacccttcacatccactgctccgaggggagctatcccaactgccctgggcttcatctagctttctattggattactgccactgtcttgtgactgcaacctccagtctcgcattctatcattccaatgtctacattgccaccagggtgacccttctgaaatgcaaacctaggcacagcaggtttctgttgaacaacctctgtaggcacacctaggatgaagtcaaattccttcaagtggcattctagacctttctcagtctacttgtctgacctcattgcctcccactcctgatcctgtagaccctatgctctaggaaaactccttttcactgttccctcaatacattatgctcttttatgtctccaatgcgtttgcactcatctttaaaacccttcaagttcaaaggcagttaccatccggtcctaaaaatgcccccactgtcttctcagggatttaaaacatctagaaacccaaaattatatgtatacatgaaaaaaagagactatgataacaaaaatagatatccaaaaggacaaaaactagaaggaaatacacaaatttgaaatcacccatgtaagtaatagggttatgaacaatttatttttcttctgtaagttgttagtgttactgaaacatattttttaataattaaaaaggacagggcaggcgcagtgcctcacgcctgtaattccagcactttgggaggccgaggcgggtggatctcctgaggtcaggagttcaagaccagcctggccaacatggtgaaaccctgtctctactaaaaatacatagattagccaggtgtgatgatgggtgcctgtaatcccagctacttgggaggctgaggcaggagagtcattgcttgaacccaggaggcggaggttgcagtgagccgagattgcaccattgcactacagcctaggcaagttaaactccgcctcaaaaaaaaaaatggaaaaaaagaaagaaaaaggataacaagcacaacaagcaatgacataccaaatgatagcaaggacttaagtaaagagtccaccttcaggacaagtattcaagtgaaagaacaaagtagattggattgaccacagacaccctcacagaagagaagagtcgtgagtaagcagtgggattcagaggcaggggacagggggtcttagctagcagatggcctgaaccatgtcacaaaggatgggatgagtggttggcagacagacaatcaagactgctgcctataaaaagtgagtcaaggcccagaacaggctggccctaggagtacaggcaaattcatggaagtcagacatctaaacaagagatgatctgatcatacttggtatctggaattgccacctgtgtggttggtacctgagaacacacctcaggtgctagagccttggagcttctaaaggagctcactttttcggagctgcactctggagtcccagtcatttctacaggagcagacaagtagtcccgggttcagcaaaccccgttccccacaagcaaacagaggaggtctcagtccctgtgtccccaaaggccaataagtaaaagtgaacaaaccagtccccaagaaggaagactaaagctagtgctgtgaggttaatattggccaacatgtttacactacacagctgaattttttcattgtattataaaagcaattgaaaatacaattttatacatggggatattaaaaacgaaggaggtgtatcctctctagtccataaaatgcaatttaactccatttgttctaatgtctgtgaaagaactgattcctttacactacatctctctcaatttctgtgctttgggtgtgtaagtcatgcttaacaaattagcatcaatgatgtaaaccaataatctgtcttattcagacgtcagggcctcttaagtccttgcacctgttcatacctccaaacacaaacaatgaagatgaaggaaacctgaaacttactcatttattttctgttctaaatccacttacctgattttgaaaaatatatccttacaatgacattattaggtttgtagatcttatatacaatatgatttttttaagtttgctactttgaaaatttacctgaatttcttaatttgaaaacttacctaaaatctctagaactaaatgctttctttattgtgactaatacaacagtaaaagatgaaactctctcctgcctgttttcctgatatttggtgaaaacaagtagctggcaccacagagtaaccaaccatttccttagggtctctgtacaggcctgagcaggctgcagcccattactggactacggaaaacactccgggaatccaggagtgactacctgcgctaactgaccagaaaaaagtgggggctttttgtcttttttcttttacatattggcatggttcagcgaattcaatctttgaaacctttccaatgtgctaaataatggattattggagggctttctaaggcccattaatggtttctcacttaagtcacatggggaccatcattctgctagccttccaagtaaaaacaaaacatcaggtcactttggatcttccctcctccacacaccctatagtcttaccctaaattaccactatgacagagcaaccatcatctgcaaattttccccacttcccaatgcctacactattgtccagtgataccggtagccaagggtgtggatatcaactttgaggacattgtactcagtgaaagaagccagacacaaaaggacaaatagtgtaggattccactcacaggaggtccctagagtggtcaaatccatagagacagagagtagacttgtgggtgccaggggatgggggagaggttggggagttggtgttgaatggggacagtgtttctatttggggagatgagcaagttctatggctggatggtggtgatggctgcacaacactgaatgtgctgatgttattggactgtacacttaaaaagagttaagatggtacattttatgctatgtgtattttaccaaaatacaaactttttttcaaagggtatagacagcacctaggttcactctgtgcatgaaacctggacctttgccccaacacacccttggcctgtcttctcactagtccctgaaaaggctgtgctcatttctgtccctaagcctttgctctcctctagcctggaatgccgctgcctctcacttccaagtctccaaatgcagcatgcatttctccttcttttgtccctgatatcacttcgtgtttaaacttctgatatgggcagttaattttgcagtttcttgtcatttcatcattttatgttcatggcttgtcccacaccccctgcctgaaaacaccctaagttccccgatggccccgggctgggtatcacacttcgcataatagaaaatgttgaagcacagagcagctctcaaaggtgtgatgaatgatcaaatggcaggtggaaaggagaaaattttagccagatgttctattgtgcccaccttcctctgagatgggcaattgatggaagtgagggacttgaggcttaagctcctggggagaaactataataggtcagcagacactccggggcagagggggacagtgcatccccaagagttaaaggagtcctaaaggaggaaaaccaaaccccagctcacccctgaacagactgtcagcccatcagccttccctcttctgaggaatggtggaatccttttggggaatggtggaacactgggaaggcagtgctggaagaggaggaagaaaccgtgagtgatgagttattgcaaaagaagaaggtaaactatcaaatcggtaactgtttatactgatcagtcattgaaatgataacacttttggatatgtcgagttaaataaaacacatcattaaaattaatttcaccagttacttttaaataaggcaaaattcttctaaatgaggctactagaagattttgaaaacacataaatatcttgcataatgtttctattggacagtgcagcccctgaggggacacggcccagtacaacacgccgtggcagcctgacatccccaaagcaaccaacgccttcttctccccaaaccacactcctccagagggacttgacttcaatgagttgaagactgtgccacaggcaaccagctgtgtcaaggaccaacgcagaacaagctcacacttattcagcccagcaggaccctgagtctgggaagcatggcgtgccacatcgggttgtccctcagaaaaaccctgctaggtgggaaggagccacctgcacctgtgaggctgcggaggacaggctaggggcagggcaggttgtacgtgcatgtgcatgcgtgcgtgtgtgtgcgtgcgtgcgtgcgtgtgtgtgtgtgtgtgtgtgtgtgtgtttcggtgtgtgtgtgggtggggcacagccagacagaagctgaggaagtactgctccccccaccccaggtaggggcagccagccagggaatggcagggtcatatggcaggaggcaggtgctagcctggcagcccaagggcctgtcgtgggctctgggcagggcagagagccgtcgggagcagaatcaaagagggcattggaggaagaagcttctgagcagtcagagcaggccgcggccggtggggagctggcccgaagccacagactggggagctttggccctgcctgaggtaggacggtagggaggagccccaggctctccctggaggacacaagggggcccccgttggctgtgcagagcctgggccctcggacattgtggtgcacagcaaagaagcccttcttggttcaagagcagacaatgctcccactcaacctgtggaggctgtaagggacacgtccgaggtcagccagctgggaggcaaccaggtggggagaaacacacacggagacctcctctgcgtcccggcctgcgttggaggcactcagcaaggctggctgtccttgggacttgtttctcaagagccagtactacagcaggtgctctacggaggcgtctggtcaccaagcaacccagagccttctgtgaatcttgattgcagcatctccaatcaagtgccacctcacagtacagtgcttccgtgtttatcccttcaggtgtccaacatctgctgggcacgctggctctgtgcagtgccttctgctggcaatcagggggaccaagccaaaaagatggaagcctctgggagccaaaccaagcaggggccacctatacaattcctctacctttaccagggagtctgcctgcccacagggcagggctgggtgctgcggggcagggtggggagggacgggaagatggagagtggcaggctggcgggagggaggaagagggcagagcgaatgtctacctgggtgtcacacgagccacttgaatgtgaccacggccacaggaactcatccccatgcccgtcacccctctttccacaaaaggcaagaggaaagacaactgccagcatgatccccatgtcagacaagggtcctgccttccacccggtccacacacaacaaggaacccgggaccctgcctgagccctccccgggccttctccctctctagagcctgtatcttctgctttcccttagaccctccttgcccagccccggggtcgggggggcctggacttgggctgcagccccctcgctgctccaggcttcccatcctgctgattagttcccccagacgtctggccggccggtctcagcatcaccacctcctggcttcaaacccatcggggctccccacagccctcaggataaggtcccggtaccctggcaggctggagcaggctgacagattcaggcacttgctggaaagaaggcaccgagagcctcctctgggccacactctgttctaggtgctggggatctcagggtaggaaacgctgtactacggtttgaacgttgtgtccctgccaaaattcatgttgaaagttagtccctaacgcagcagtgttaaggggtgagacctttaggaggcaatgagaccatgggggcagagccctcggggatgagaggagtcccttgtaaaaggctggaaagcactaggtaagccccctttttgctgttccctccccacgaccatgtgaggacgcaggcacaagacaccatcttggaaggagagactgagcccccaccagatgctgaacctactggtgccttgatcttgggcttcccagcctccggaattgggaacaagaaatttctgttcttttgtaagtttcccagtctccagtgccttgactttgagcttcccagcccccagaattgggagcaatacatttctgttctttgcaagttacccagtctcaggtattttgctatagcagtgcaaatgggctagacacacaggcaagtccactccaccttctggggctctagcttgccacctggggagggagcccctgatacccaaaagcaaagactcagaccagcatttctcacgtgccgacacatgtactgatgccgccaataagaatataaaccgagggcacgtgatttgtgtgtcccagcagagggggcctatgggaggaggggacagttcagctgagacatgaaggaggaggaggtgcaggaggagggggaggaggaggagggggaggaggaggaataggaggaggaggaggaggagggagaggaagagcaggaggaagctgctgccacagaaggttcttgggcctggatggctcacacagaggaaggagggatggcaaaggccgaaggtgggaacaagccctgtgctttggggccagctgaacaggccagatcggcaggaatgtggtgagaggagctgggggcatggcaacatggggtggatttcggggaaggaaggagagcatcagaggaagccagatccccaggagcagcgtggggggtgctcttgaccaggatggggactttgagattactctaaggagatggggtgccacagggaggagcagggtctggtggtgttgcaaaaagatcaccctggctgctgagggggtgttggtggagcagggaggaagcggagtggaggcagggagaacaggaggcagggcgggccaaggaccacggagatgagaagggtagcagtcttggagcagagtcaacaaaatccaatgatgggttagatttgggagtgaggaacaaaggagaggggagagaatcttggctgctttgtttgagtcaccaggtaggaggcagagccctttgcacagagggggaagcccggggacagtgtaggcatggtgaaggggacgaagccctccggtttgaacatcttagctctgaaatgtctgcggggcatccacgtgggcagatggatgggtacgtgcggagcttggaagagaggtcacgtccagagacagagcattcatcggaggtgccgtatgtcccagggttgaggctgggagcccgcccccaccacgcttagatccagcaaagtaggaggaggaggaggaaggtccaagggcagagaggcaggtagagagggaggaggtcagcccaaaagtggggtgggggagaggaagaagctgagaaaggaaatggttttgagaaggaaggagagtcaactgtgttgagaggtggagacaatggggacagaggactgacaaaagaaagacagttgacgtgtcacagcccagccttgcccggggttggcggggggcaatgggtgtcctgcagcgtcctggacttggagtcagcaggtgcagaaggaaggagagtgggaagagacaaggccgaaaacaggaaattagttgcgagccggccggtgggctggctgggccagttggagacaccagacccacagatgttcccagggcgggggcggccgaggcggggggggggaggggggggggtcggtgccctttctgaagaaggactccagaaaaatcacggctgaaaacaagagagaggacaatatgtggtataagccgtgacaagtctaacactaaaggttcgatagacagacactctcacagcagaggtaaagagcagcagtttgcctgaatgagaacaagcagtcttggccctcaagggggagaagcggtggggggcaggggggcggggaggactggacacacgagcccaaccggggaggctgctttgtgacagaagacatgcgtttcttcgctgaccccacgtttactacctgggaggtagaaaagcctggggagcaagaccatgccaacctaagtaccacacagagagggagcctccctataagaagatggtattcagaaataggcactgcagtggggacgcgtgcgccctagtgaactatgtgcatattcaggcaggggaaggcagacaaaggtttttcaggacaagtgaagaggattacataattgttttgacataatgatctttggctacaaggatgaataacaagggtagcattggtcaggggcttggacaggaagttgctgggcaggtgtcctcacagaagtattatttgtgtcaggttgcaacagcctttgtgcaaatttgtgggttttgcagtcttctgtgatagcttttgttatcaggcattcgtgcatgggaaccctgcctaggtggccctccacagctctatttgtcaggtttttggatttttgtttgcttgaacaacaagtgactccatcttgattctgaaacctttcacaaccatacgggcaagccaaagtctaattgtgaggcccactccaatgcgacctgcttctgggcaacgtgatagactggccatggcttatatcacaaaaggagaaaggcttcgatcttgacgctaggaactttctcctggaaacgggccgatgacgcctgtcatctgcgagatgaggaggaaaggagcaaaggagattcacagaagaggaaccaggaacggccagtgagaggatgcacgacctcgccaccgctcggggaaacgcaaggcacacagcgatgaggtggtgtctctccccgtgggatgggcaagcaggcgaggctggacaggaccaaaggctgctcgggctgtaggaacccaggaccgctcccacgctgccagtgcgagggaacatgggttcagccacgcaccggaggtcacagatgagcaatgcttggttgtggcgttgataggcacagcccaagtcccagcagagccactgcctgctgtgcaccccagagtctttctggctgacggtggtggctcagacaggcatgcgggatgccactggcagcagtgtctgcaacagccaaacagtgggaaggaccggaatgtccatccccagggtcatagacaaatactctggggctgtgattcagcaaggagcttgggcgagctggacgcttgggggaaaccttggccagcaagttgccaaacaggaggtcaggcaaggaaagagaaggggatgagggaacgacacccagaggtgtgaccccgtgggaacctgtttgccacctgcctggtggagatgctgttcacatggccccagcctcccgtgatgggtcaggtgcagggtggtcagatccacgggcgcagaatctctgttttgagcggaggctgctctgccctggcgcagtgtctagccccggcaacagaggactggggaaggacctatggaaggctgactcaggccctgacagacggaggtctccagggaggtacgacacccatgctgccctcagggccaagagagcaatgtcccagagcccatcaggctggtgagggcacagggggcaggggacaaattgagtagcccactccgcgcggactacctttccaggcacacactcaggcagagacccagactcgggacttgcggctgcaaaacggacgaggcccgggcatacttgggtgctgggtcaccctcctaggtgctggctcctggcaccagggcagcaaagtgcttcggccggagggctgcgggtccctgaagccggatgggcagcggggagatggcagaccctccgtaggatggtgtgcgtgagctgcgtgagcgcctggggcatctcctccacggaatggcacccgcaccaggtgcccctggcctcgcctggccttgccagccagaggaccagtcctggacggggagggggaggacaagagcaggtgcacaggccccagaacccggctccctgaccctggccagaacgcagagctgccggacgcacctcagaccactccctggccctctggtgggcacgccggggtgcacacccgtcgccccgctggcgcctgcctccggggcacgtgcgggaggggcagaggcctggaccaggaaccgctgtggtgagagccaaaggcgctgggacctgcggcccacagacctttggacaccccggtgggggtgggggtgggctggcgcctgtgttcccgggacccgcggcgcgaggggagtgggggtggggctaggggataggagcaggtgacgtcacccggggtcctggggcgctcgggaaggcggcgagagccaggccacgtgacccgcccgcggcaacggccctgcgctctcccgggccggcgacgcggaggggtccgcgctgcaccgccgccgcaccccggccgcgtgaccgcactgcagagagcggctgcgagcaggcgcctgcgcaccggcccaaacgccgagcgagcgagggagaggcacagtcagagggaacgcccgcgcggggagccaggggcgcccgaccccgccgccgccgcagcggcgcgcagcccccgacgcgccctgtggggacccggaccaggagggaccctgccccgggaaaaggtatcagacccacccggggagggggacgctgggtcccgggagactccgccgcccctcgcctgtccgccctaacagaactgaagcagcctgcggggcagcggtccggggtccggggtccggggtccggggtccgggggcggcgcggggatgaggccaagacccgcagggaccacccccccgggggggcggggcgggacaggggcggggcctggctgcagaggcgcggccaggggaggagggcggctgggggtgggagtggacgtggacgtggacgtgggcgtggggaggggtgggcattaacctcgctctcgcccgctcgcattcacaggctgtggagacctgggctccgaccccagttcatccccccacacccccgccgccccgagccaccctggtccgcgctgggaaccctatcctgcccctcgtgtcagcccggcactggccagaatcgcgggcatggcggtgaccatgctgcaggactggtgccggtggatgggggtcaacgctcgcaggggcctgctcatcctgggcatcccggaggactgtgatgatgccgaattccaagagtccctcgaggctgccctgaggcctatgggacactttacagtgctaggcaaagtgtttcgagaggaggataatgccaccgcggccctggtcgagctcgaccgggaagtcaactatgctttggtccccagggaaatccccggcactgggggcccgtggaacgtggtctttgtgccccgttgctcaggcgaggagtttctcggtctcggtcgcgtgttccacttcccggagcaagaggggcagatggtggagagcgtggccggcgccctgggtgtggggctgcgcagggtgtgctggctgcgatccatcggtcaggcggtccagccctgggtggaggccgtgaggtaccagagcctgggcgtgttttccgggagggaccagccagccccaggggaggagtcctttgaggtctggctagaccacaccaccgaaatgctgcatgtgtggcagggggtctcggaaagggagaggaggaggaggctgctggaaggcttgcgtgggaccgccctgcagctcgtgcacgcgctcctggcggagaaccccgccaggacggcgcaggactgtctggcggccctggcccaggtgtttggagacaacgagtcccaggcgaccatccgggtgaagtgtctgaccgctcagcagcagtcaggcgagcgtctctcagctttcgtgttgcggctggaagtgctgctgcagaaggccatggagaaggaggccctggccagagcatccgccgaccgcgtgcgcctgaggcagatgctcaccagggcccaccttactgagcctctggatgaagcactgaggaagctgagaatggccgggaggtctccaagtttcttggagatgctggggctcgttcgggagtctgaggcatgggaggccagtctagccaggagcgtgagagcccagacacaggaaggggccggtgcccgggctggtgcccaggctgttgccagagccagcactaaagtagaggcggtcccaggaggtcctggtcgggagccagagggcctccgccaggcaggaggccaggaggctgaggagctcctccaggaggggctcaagcccgtcctggaggaatgtgataactaggttggggctggggaggcagcccagcgcgagtcctccccgggcaaataggctccgagggccccggggcctcctctcctcctctcaggcagcagggccctggagacaggcggaggcggggccagggccggtccctcaccccacatcgggatcggggccagctgtggcctgggtgggggcacctgaagatgtctgccccccactccttgtcctgggttgggagaggcagggggaaagaggccctctcaagggtgtcagctgcctgggtctcccaagagcggtcccccacccgccgagtcctccacatggctcccgtgtgggcctctgacttcatgcccaggccctcctggggctcttccctgaccttggcttccagcctgaggttacacatgtggccactctgacccttctgaaagccctgagcgccgccccccccaccccaccccgcagtgctgtcagggatcctggataccaggacctagcctactgtccctctgcctgtctgcaacgtccaaaccacctactcctgggaggtgatcagcgtgccctgggaacccaatcagcccctgctcaagactaccacgccatcccgtgcagcccaggggaccacacagaccctcagggaccaagcaccccacacaccccgatgttagcccagccactgtggcacctcacctcaccttgtccccagccaacactgcaccccgcaccccgcaccccatgcagtttcccacagcagaggcgaggccggctggaacactgaatgaaatttattgaagagagatatgtactgaaaccgttgaagagaagggaatcacaacacagaagctgcaaatggccaccacaggacacaggtcgggacccccctcctcctgggggaacacccaccccaggtctaggaaactcagtaacaagtaacaacaggggtggaacgccaaagcacaaagttcactggggaacctcagacagccccactccatcccgggtcctgttctttctcccacagtcatggtcaccatcgctgtcacgggatgagtgtccactgtgccctggtgccttctttccgccatctcccgggactgcgctggggtcctctggggaggagctgctcagagaagaacacacacggctccacaaaaacaagcagcccctggcctagatctacgcagggaaagcagaggtggtgctcacgatacgggagagcagtgagcacaacctgggctcccaggaagctcacagcacgtgcccctggcactggaggggcgcctccccccaccccatttggtattaaatgtggtcatctgggtcaccgggaaggtggtggtgggcagggccccttggggggaagtggggggccccgatcccgatgtggggtgagggaccggccctggccccgcctccgcctgtctccagggccctgctgcctgagaggaggagaggaggccccggggccctcggagcctatttgcccggggaggactcgcgctgggctgcctccccagccccaacctagttatcacattcctccaggacgggcttgagcccctcctggaggagctcctcagcctcctggcctcctgcctggcggaggccctctggctcccgaccaggacctcctgggaccgcctctactttagtgctggctctggcaacagcctgggcaccagcccgggcaccggccccttcctgtgtctgggctctcacgctcctggctagactggcctcccatgcctcagactcccgaacgagccccagcatctccaagaaacttggagacctcccggccattctcagcttcctcagtgcttcatccagaggctcagtaaggtgggccctggtgagcatctgcctcaggcgcacgcggtcggcggatgctctggccagggcctccttctccatggccttctgcagcagcacttccagccgcaacacgaaagctgagagacgctcgcctgactgctgctgagcggtcagacacttcacccggatggtcgcctgggactcgttgtctccaaacacctgggccagggccgccagacagtcctgcgccgtcctggcggggttctccgccaggagcgcgtgcacgagctgcagggcggtcccacgcaagccttccagcagcctcctcctcctctccctttccgagaccccctgccacacatgcagcatttcggtggtgtggtctagccagacctcaaaggactcctcccctggggctggctggtccctcccggaaaacacgcccaggctctggtacctcacggcctccacccagggctggaccgcctgaccgatggatcgcagccagcacaccctgcgcagccccacacccagggcgccggccacgctctccaccatctgcccctcttgctccgggaagtggaacacgcgaccgagaccgagaaactcctcgcctgagcaacggggcacaaagaccacgttccacgggcccccagtgccggggatttccctggggaccaaagcatagttgacttcccggtcgagctcgaccagggccgcggtggcattatcctcctctcgaaacactttgcctagcactgtaaagtgtcccataggcctcagggcagcctcgagggactcttggaattcggcatcatcacagtcctccgggatgcccaggatgagcaggcccctgcgagcgttgacccccatccaccggcaccagtcctgcagcatggtcaccgccatgcccgcgattctggccagtgccgggctgacacgaggggcaggatagggttcccagcgcggaccagggtggcacggggcggcgggggtgtggggggatgaactggggtcggagcccaggtctccacagcctgtgaatgcgagcgggcgagagcgaggttaatgcccacccctccccacgcccacgtccacgtccacgtccactcccacccccagccgccctcctcccctggccgcgcctctgcagccaggccccgcccctgtcccgccccgcccccccgggggggtggtccctgcgggtcttggcctcatccccgcgccgcccccggaccccggaccccggaccccggaccccggaccgctgccccgcaggctgcttcagttctgttagggcggacaggcgaggggcggcggagtctcccgggacccagcgtccccctccccgggtgggtctgataccttttcccggggcagggtccctcctggtccgggtccccacagggcgcgtcgggggctgcgcgccgctgcggcggcggcggggtcgggcgcccctggctccccgcgcgggcgttccctctgactgtgcctctccctcgctcgctcggcgtttgggccggtgcgcaggcgcctgctcgcagccgctctctgcagtgcggtcacgcggccggggtgcggcggcggtgcagcgcggacccctccgcgtcgccggcccgggagagcgcagggccgttgccgcgggcgggtcacgtggcctggctctcgccgccttcccgagcgccccaggaccccgggtgacgtcacctgctcctatcccctagccccacccccactcccctcgcgccgcgggtcccgggaacacaggcgccagcccacccccacccccaccggggtgtccaaaggtctgtgggccgcaggtcccagcgcctttggctctcaccacagcggttcctggtccaggcctctgcccctcccgcacgtgccccggaggcaggcgccagcggggcgacgggtgtgcaccccggcgtgcccaccagagggccagggagtggtctgaggtgcgtccggcagctctgcgttctggccagggtcagggagccgggttctggggcctgtgcacctgctcttgtcctccccctccccgtccaggactggtcctctggctggcaaggccaggcgaggccaggggcacctggtgcgggtgccattccgtggaggagatgccccaggcgctcacgcagctcacgcacaccatcctacggagggtctgccatctccccgctgcccatccggcttcagggacccgcagccctccggccgaagcactttgctgccctggtgccaggagccagcacctaggagggtgacccagcacccaagtatgcccgggcctcgtccgttttgcagccgcaagtcccgagtctgggtctctgcctgagtgtgtgcctggaaaggtagtccgcgcggagtgggctactcaatttgtcccctgccccctgtgccctcaccagcctgatgggctctgggacattgctctcttggccctgagggcagcatgggtgtcgtacctccctggagacctccgtctgtcagggcctgagtcagccttccataggtccttccccagtcctctgttgccggggctagacactgcgccagggcagagcagcctccgctcaaaacagagattctgcgcccgtggatctgaccaccctgcacctgacccatcacgggaggctggggccatgtgaacagcatctccaccaggcaggtggcaaacaggttcccacggggtcacacctctgggtgtcgttccctcatccccttctctttccttgcctgacctcctgtttggcaacttgctggccaaggtttcccccaagcgtccagctcgcccaagctccttgctgaatcacagccccagagtatttgtctatgaccctggggatggacattccggtccttcccactgtttggctgttgcagacactgctgccagtggcatcccgcatgcctgtctgagccaccaccgtcagccagaaagactctggggtgcacagcaggcagtggctctgctgggacttgggctgtgcctatcaacgccacaaccaagcattgctcatctgtgacctccggtgcgtggctgaacccatgttccctcgcactggcagcgtgggagcggtcctgggttcctacagcccgagcagcctttggtcctgtccagcctcgcctgcttgcccatcccacggggagagacaccacctcatcgctgtgtgccttgcgtttccccgagcggtggcgaggtcgtgcatcctctcactggccgttcctggttcctcttctgtgaatctcctttgctcctttcctcctcatctcgcagatgacaggcgtcatcggcccgtttccaggagaaagttcctagcgtcaagatcgaagcctttctccttttgtgatataagccatggccagtctatcacgttgcccagaagcaggtcgcattggagtgggcctcacaattagactttggcttgcccgtatggttgtgaaaggtttcagaatcaagatggagtcacttgttgttcaagcaaacaaaaatccaaaaacctgacaaatagagctgtggagggccacctaggcagggttcccatgcacgaatgcctgataacaaaagctatcacagaagactgcaaaacccacaaatttgcacaaaggctgttgcaacctgacacaaataatacttctgtgaggacacctgcccagcaacttcctgtccaagcccctgaccaatgctacccttgttattcatccttgtagccaaagatcattatgtcaaaacaattatgtaatcctcttcacttgtcctgaaaaacctttgtctgccttcccctgcctgaatatgcacatagttcactagggcgcacgcgtccccactgcagtgcctatttctgaataccatcttcttatagggaggctccctctctgtgtggtacttaggttggcatggtcttgctccccaggcttttctacctcccaggtagtaaacgtggggtcagcgaagaaacgcatgtcttctgtcacaaagcagcctccccggttgggctcgtgtgtccagtcctccccgcccccctgccccccaccgcttctcccccttgagggccaagactgcttgttctcattcaggcaaactgctgctctttacctctgctgtgagagtgtctgtctatcgaacctttagtgttagacttgtcacggcttataccacatattgtcctctctcttgttttcagccgtgatttttctggagtccttcttcagaaagggcaccgacccccccccctccccccccccgcctcggccgcccccgccctgggaacatctgtgggtctggtgtctccaactggcccagccagcccaccggccggctcgcaactaatttcctgttttcggccttgtctcttcccactctccttccttctgcacctgctgactccaagtccaggacgctgcaggacacccattgccccccgccaaccccgggcaaggctgggctgtgacacgtcaactgtctttcttttgtcagtcctctgtccccattgtctccacctctcaacacagttgactctccttccttctcaaaaccatttcctttctcagcttcttcctctcccccaccccacttttgggctgacctcctccctctctacctgcctctctgcccttggaccttcctcctcctcctcctactttgctggatctaagcgtggtgggggcgggctcccagcctcaaccctgggacatacggcacctccgatgaatgctctgtctctggacgtgacctctcttccaagctccgcacgtacccatccatctgcccacgtggatgccccgcagacatttcagagctaagatgttcaaaccggagggcttcgtccccttcaccatgcctacactgtccccgggcttccccctctgtgcaaagggctctgcctcctacctggtgactcaaacaaagcagccaagattctctcccctctcctttgttcctcactcccaaatctaacccatcattggattttgttgactctgctccaagactgctacccttctcatctccgtggtccttggcccgccctgcctcctgttctccctgcctccactccgcttcctccctgctccaccaacaccccctcagcagccagggtgatctttttgcaacaccaccagaccctgctcctccctgtggcaccccatctccttagagtaatctcaaagtccccatcctggtcaagagcaccccccacgctgctcctggggatctggcttcctctgatgctctccttccttccccgaaatccaccccatgttgccatgcccccagctcctctcaccacattcctgccgatctggcctgttcagctggccccaaagcacagggcttgttcccaccttcggcctttgccatccctccttcctctgtgtgagccatccaggcccaagaaccttctgtggcagcagcttcctcctgctcttcctctccctcctcctcctcctcctcctattcctcctcctccccctcctcctcctccccctcctcctgcacctcctcctccttcatgtctcagctgaactgtcccctcctcccataggccccctctgctgggacacacaaatcacgtgcccttggtttatattcttattggcggcatcagtacatgtgtcggcacgtgagaaatgctggtctgagtctttgcttttgggtatcaggggctccctccccaggtggcaagctagagccccagaaggtggggtggacttgcctgtgtgtctagcccatttgcactgctatagcaaaatacctgagactgggtaacttgcaaagaacagaaatgtattgctcccaattctgggggctgggaagctcaaagtcaaggcactggagactgggaaacttacaaaagaacagaaatttcttgttcccaattccggaggctgggaagcccaagatcaaggcaccagtaggttcagcatctggtgggggctcagtctctccttccaagatggtgtcttgtgcctgcgtcctcacatggtcgtggggagggaacagcaaaaagggggcttacctagtgctttccagccttttacaagggactcctctcatccccgagggctctgcccccatggtctcattgcctcctaaaggtctcaccccttaacactgctgcgttagggactaactttcaacatgaattttggcagggacacaacgttcaaaccgtagtacagcgtttcctaccctgagatccccagcacctagaacagagtgtggcccagaggaggctctcggtgccttctttccagcaagtgcctgaatctgtcagcctgctccagcctgccagggtaccgggaccttatcctgagggctgtggggagccccgatgggtttgaagccaggaggtggtgatgctgagaccggccggccagacgtctgggggaactaatcagcaggatgggaagcctggagcagcgagggggctgcagcccaagtccaggcccccccgaccccggggctgggcaaggagggtctaagggaaagcagaagatacaggctctagagagggagaaggcccggggagggctcaggcagggtcccgggttccttgttgtgtgtggaccgggtggaaggcaggacccttgtctgacatggggatcatgctggcagttgtctttcctcttgccttttgtggaaagaggggtgacgggcatggggatgagttcctgtggccgtggtcacattcaagtggctcgtgtgacacccaggtagacattcgctctgccctcttcctccctcccgccagcctgccactctccatcttcccgtccctccccaccctgccccgcagcacccagccctgccctgtgggcaggcagactccctggtaaaggtagaggaattgtataggtggcccctgcttggtttggctcccagaggcttccatctttttggcttggtccccctgattgccagcagaaggcactgcacagagccagcgtgcccagcagatgttggacacctgaagggataaacacggaagcactgtactgtgaggtggcacttgattggagatgctgcaatcaagattcacagaaggctctgggttgcttggtgaccagacgcctccgtagagcacctgctgtagtactggctcttgagaaacaagtcccaaggacagccagccttgctgagtgcctccaacgcaggccgggacgcagaggaggtctccgtgtgtgtttctccccacctggttgcctcccagctggctgacctcggacgtgtcccttacagcctccacaggttgagtgggagcattgtctgctcttgaaccaagaagggcttctttgctgtgcaccacaatgtccgagggcccaggctctgcacagccaacgggggcccccttgtgtcctccagggagagcctggggctcctccctaccgtcctacctcaggcagggccaaagctccccagtctgtggcttcgggccagctccccaccggccgcggcctgctctgactgctcagaagcttcttcctccaatgccctctttgattctgctcccgacggctctctgccctgcccagagcccacgacaggtccttgggctgccaggctagcacctgcctcctgccatatgaccctgccattccctggctggctgcccctacctggggtggggggagcagtacttcctcagcttctgtctggctgtgccccacccacacacacacggaaacacacacacacacacgcacgcacgcacgcacacgcacgcatgcacatgcacgtacaacctgccctgcccctagcctgtcctccgcagcctcacaggtgcaggtggctccttcccacctagcagggtttttctgagggacaacccgatgtggcacgccatgcttcccagactcagggtcctgctgggctgaataagtgtgagcttgttctgcgttggtccttgacacagctggttgcctgtggcacagtcttcaactcattgaagtcaagtccctctggaggagcgttggtggggcattggttgtggaggccggtggcagtgggctgggtggttccatggggctcagggtacaactgcattggtgatcagtcctctctgccttggtttgggattgaaatggccttcatagcaagctcagcccggtgcttgctcccagtgagcttgcctgcagctagatgccatcagcatcattcctcccacagctgccttccagctcccttccttcctgtgtgtgccactggctcttccaacccatggggcacactcactctcctcccaaggaggcagtgtcatctgggcatggctggccctttctgccaggagtccagggattcctgtcagaggcccctgctcctgctctttctgccctcgagcctgccggccctcctcactttgactttggagtttggatggtgactcagcagtcaaccagcattcaggggcagggccacggtttctgggagagaagcctgcagatggctgcaccctggttccagggactcgtgtccctgtcctctcctggaggactccggggtcctggcttcccaggtgctatgtgtgttgaacggtgtctcatatcacatatcagagtgaattttgggaccatggttgccaaggaaatatcaaggtttggctggagttggccccataagtgttctgtgctgtgtttctctgttgcctgcttccaaattgctccgtgaagttcaggccattcgtctgtgtccttttggttggttctgtggaagatagtttcctcgttggtctagttagccacaagaaaaagatgcccatggttttctcaaatcatgagtttgtgagcactgggcagtgatcaagttccctgggggatgccacaataaattttccctgtaggcaagactttaggagcaaaccaataggatagctcatagtcatagctcacagcaagcaagttgcctgcttgaaggatgggcctatgctgtgaaagtctgttggaactgagcatatcagggttctctaaatggatagaactaatgggatctatatacatatatatatacacatatacatatatatataaaaactatatatacatatacatatatataaactatatatatatacacatatacatatatatatatatatgggagtttattaagtgtttatactcccatatatatatatgggagtttataaccatatatatatatatgggagtttattaagtgtgtgtatatatatatatatataatatatgtgggagtttattaagtattaacttacacgatcacaagatcccacaataggctgtctgtaagcttgaggagcaaggagagcctgagtctcaaaactgaagaacttggagtccgatgtttaagggcaggaagcatccagcatgggagaaagatgcaggctgacaggctaggccagtgtctcttttcacatttttctgcctgcttatattctaacctcgatggcagctgattacattgtgcccacccagtttaagggtgagtccgcctttcccagcccactgactcaaatgttaatctcctttggcaacaccctcacagacacacccaggaacaatactttatattcttctatccaatcaagttgacagtattaaccatcacactgagctgggctgaactgtgcctccttgaggacataccacactttctggtagaaataaggcttttaagggtgtcagctcagaggagagaaggcagccagcagcacatggcctccggaagatcccaggccgtccctcttgtgacacaatgtgaccccatggcctggagttttggatggggggatgggaagaaggtgagtagtgctagctgacaagagctacctctaggggctttttgatgatcagtcaaaactctagtttcccaaggggaagtgtggctcaagactggaaagagaccctgtccaacagaaatctccttgtctcctggctctggtgtctctccaacctcagcagatgagagcactcagtagtccctggatttagccaacatctcgacctctgtagccacctctggtgtatacgaatgccccctccaagctatccctaacactgcttcctcgctgacttttctagttcacagacatgagcaggtcattcctatccttcacaaatatcagggcagtggtcattccctgaagacccaggtgccttgctgcacttctagggcagaagtccaaagttgttagcaaagtacttagcattacagacccttcgtggccctgtctgacctccctatggagctattgtcttctccttgcctctctgtccatcaccctgggacccagccacactaactttcactacagcctccaaatatctacagatcattcaaccccattcatcaaagagtgagtgccttggctgtggagagctcaccaggactgcaagttttgagagaagggaaacaaatgatgtagggccaaagatcagcccagatatcagcttagaagcacttacagtctatggcaaagcaaaggaagaatgcaaacagcatgtggcattctcactgagttgtgcaattgaatgccactggggtttctagaatttgcagtcactgtacagaagagaagggaaatgagcaaagaaagagctccagagcacctcacaaagttcccactgagtctttggctgcatactaagttctgctcagatagagacaccacaaggttgagcacagaacacctccaaagctgtgagctggacaattgtcaaagctcacacagtgttcagagatgttcaatttcccaccagccacagtggagagaccacattgaaatagctgggcattcagtacagagcctagaaatgccacacctcgggagcaagtctaaggtagaatgaaaacccacattaacaaagtttaaaaacaaggcttcaaaggcttatgctgctctgtaagtaaacaaactgcctgctggaacaactcaacacagaattaatggaaacaacaagaccaagatattttacatcctaacctaaaatatccagattttacacaaaaacttctagacatgggaaggagaaaaacgtgacccacaccaaggagaaaatgtttcaataggcccagaaatggcaaggacgatgggattagcagatgagaacttaaagacagttattagaagtaaatgtgttgttccagaattgaaagagaaacatgaaaatgatgaagaaatgattaaggaaggatctcaacagaaaaacaacaccgataatggagaatcaaatggaagctttagaagtgaaacatgtagaagagaggagccctgtgatagacccacaggtacaaagtcaaacagtttttgaccaacactctaaataaaatcaatgtcgaaaggaaagtcttttcaaatgcatcttgaccccacaccaaaaactaatttaggtactttttttttttgagacaggagctggctctgtcgcccaggctagagcacaggctcaatctcctgggctcaagagatcctcccacctcagcctcccaagtagctgggataataggcatgcaccaccacacccagctaacttttggggttgtttgtttgtttgttttttgaggctaaggctggtctcaaactcctgggttcaggcaatcctcccaccttggccttccaaagtgctgggattacaggtgtgagccactgcacccagccaatataggtatattctaagacctaaatgcaaaagctacaactacagaggttctagaagaaaacatagatcaatatgtttgcaaatgtgggccaatgaaagatatcttaggcaagacccaggcagtggtcattgtaaaaagaaacaaatgatgcaatggacttcattataattaaacccatcagcttatgaacagacaccattaagaatatgcataagaaagacacaactggtaaaaagtgttcccagcacacatatcaaagtacttgtatccagagtattttaacaacttgcacaactctaataaaaaatttaaaaagccaggtaaaaactaggcaagggacttgaacaggcacttcgctaaggaagacagatagctaataagcacatgaaaaagtgctcgatattattagtcatcacagaaatgcaaactaatgcctcagtgagataccacagtgagtcacccaacagaatggttaaaagtttaaagctggcaatacaagattttttggagtaccctaagaaacgagcactgctcattagagtataaattgtcacaatagctttggaaatctgtgtgaagtttcttataaagttaaatataccactaccctgtggcccagccattccattcctaggtatttactcgggagaaaggaaaacaaaagtccacagagattcatacgaggatgtttctatcagctttaatcacacaataactgtaacacatatctatttttagattagggaccttaaaatagatactgcacttgatcgtagccaaaaggccaagaagccatgtgaaccttaaaaataggaatgtgccaggggtcagaaatggatgattagctagtaggcccagctctagggccatcagcctagaggcaacaaaagtctcactgctgtttggtggcaaagaaacttctacctctctctgccttctttccaaccctcttgatcccttaaagaaataaaaaaaaaatcaatcacccaacatttgcactcacacgaaaattcacacaccctctcataaactgtctcatacacactaacacacatactcacacactcacccattccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattctctaaagtgggtattttctattattattgcactgataaactgtgtagtagaaaagtaaatacaacttttctaccagtgagaaacatgtaattggatccaaaaactcataaagtgtatattgccacgtgaaagcctggttgcactgactgttacaggaccatatttccaaaaacgtttgagaaaatttctgtagagactatggagacaatactcttatatttaaaatgttttgttcctttttttttttgttcttctatagagataactcatacaagcagtgtatttggggagctttgctctgctaggtggtgacaaagtgctggttttgtgagctgcctaataagttgagtattatagatgggtactgtatgtaaaaaatatttgtattacggtgcagatcttttatgattgctgaaaactattaatagcaattgatggtagatctctgatgtgaaaccaggtttaggaaagcattccttgcagtattacagttttctgagacacggcactatggataaaaatgtcacataagaagctccaagaaaatatttcagaagtgttcgagaatgtatttgacttcttaaacttaaatttttatacacatggacattgcttcttttattacaatacagttaatagcattaatcactagagtgcttaaaaatagttttcttattgtgtattatttctacccttttgatggtcttattaaataagatacttttgtgtgctttacataatgagtcgtgacagtacttcacggcaaagtgtcctttgaattgtaggacattttctaaatgtagaaattaaattctgtgtttgtaaccctttccgtacattttaaaaatagaagcttttaattatttgcttttcatcatctgtcaattaaaagtgatttgcagttttaccatttggaattggaatactaatattaatacctgaaagattttacagaaaataagtgggaaaatcttgctttttgaaatgattcttgcattttacatttcaaatgtccttctaatattaatgaaccatcatgtcccatatcgatttgaatatattccaaggaactacttttcaacattaacttttaatgcattttcacttactatctagctgacatgcatgaaacggggtctttctgcaaagagaaaaaggcttgaaacatatacaaaagcttgcagcaacaccaagaacagaatggaacatattttgaaaacacaacaactgaaaaggtatgattgctggcttttttgcacaatgatatttatatcatttctttgtattcgttggtgcaaatcatttcagtgtcctgtacttattggcgtctccagtgaacaacgtatttcacttgattgttccctaagcaggtaagtttctttagttttataacctcagtttaacaaaattatgagatattacgtagaagccaatgaagatgacctcttttcgccttccagatagcaatagtcttcctgtataattaatttttatcaatttctagaaatatgctagctaaatgtgaggtaaatgtcttcaacgtttagttttagatccttaacgatattccattatgtagaaagggataaccttatgttttaaataagttatctattttagtgcaattgttttcgctatttcttttacaaaatcactgttgtgtcagagtggagaaatagttcagtgaaatatttcttttggaaaatcttacgggatgactggccatgatagtcttgaatttacttatgggaacccccacgttagtcagtaagaggaaaggaaaagtaaactgctcttagagaaaatgaatgtttctggtaaatttttagtgcagtaaaccctcctttgttttcagtacgtaaagaacataagacagctgatctagtagtcagttaggaagaaatccttttggaatgagagtaactcatttccccttttcccaatgagaggatttcagttgctattactcccttgttactttgccacccaggttgttctatttgtagtataaattatgtcaaatcagttttggcttgaataggattgatttttcatctctctatgaagcatgaccatgttacttattatgtgttacaggcagaaatgtaattgtagatgttctctgcagttgctgaattttcttcaagaatataacacacacatgcagaagactgaggaagaataagaaaaacaaattgttggcatcaggcttagctttatgattaacctattgcatcactgtctgaggtagtaatagttcatgcagaaatccagcaaagaaggaagagagcatgagcccagagagggttcccattagaggactaatggatgaggggaatgtaagtgccatgcagcattaggggcccaagtggggtcagcatcatagtgattaagaagttaaagtgagctcagttggtgtatttgtgcaagagcagctgtagggttggaattttctgggttggggtgtagctgagcacgttgatagagggagagttgggcagggcatagacgcagggatggggttatgatgactggttgtggaatttcagactgagttacccgagcacatgggggtggggcgttgggcagtgaaaagggctccattcaatgggtgtcaggtccggatagactcctgagctgtagtactgaagtaagtgacctacaacggcagggaggtagtggctgtatgttgggaagatagaggaacagctgagtgcagtggtcaaggaccaggactctggaaccacccaacttgggatccaactccagtttgaccattgctagctcagaaaccatgggcaaagtatttatctctgtgtctcagtttccttatctataaaaggagacatggtaagagtacctacctcagagctgtttggaggattaaagggttcctatgcaatgggtttatttaacatcttcgggatgcaatctgaccgatggttgctctttatcattgctattattaatgttacttagatgttgtagtcattgggaatgacaaaatctaggggatgactgtgtgagtgagtgtcacatagaggagagaaaacactgttattggagattaggtcaaagtgtagaaaagccagcattattgggaggttcatctatgtgcatattgaaatgaccaagattttacacatgtttaaaatcttagtaagaaagaatgtttcttagttaatttctgtatagatcttacctatctgtggtaaacaaattataggcagggtcatcaattactcttcatctgaaatcaagaattaggacatacgtgttgaatatgtataagaaaggaaatgctttactcaatgactgatgaaaaaagttattacattgttttagcgtatgagtggtgaacataattgtttaaaactggtcataaacgttgccgaaaagaaaatgttcagaagtattgattttaaagagtattcttttagagctaatgcagaattatgctttgtaagtattaacatttaccccatttcttttcacttttttgttttgtgcttctagaaaatatttagagagcaacaaaagagatggcaacaagagagagtcgttagcagacagcaactgaaagagattaagctgctacatgagcaattcatgaaggtctgttctatttggttatacaatacattcttatgaaatacaaagcgtgcataaaaatagaagacaatctgcttgtttctgaatgcatggaaagatattttggttatacattttaaattacttaccattttcactttggatgtattgttctggatttaacataattggtaaatgtatttttaggattcatgaatagttttgtgggagctattgagaacaggaaaaggtaaattggaaattttacctagaaatacgcatcttgtgtataaagtcgacactttattaacacattaattaagattttattttcagtttttaggagatcagcgacaaatctatagtggaaagcaggaagtccataaatcctttctgggtgtcttttttgcttgtcttgtttcaacagttttagttaaacaggaagtaggcaagtataactactgagtatctcttttatttcctgctgtaatataggagtgttttatggcatatttactctcaaaattattactggctagtaatggttttacatgacaatttgtaatcaaaagagatggttcagatgtataacagaatgggaaagcctgcagattattaacactttgtgcattgagaattaactgctgtcatacagcacattagcgaattgtcatcggacaatgacctcttcttgctctagatgtatattatttaggaaaccatggaattcttttttgggaggtattctttttaataaccttgtgaaaatatacgttcgtaagtcactcttctggactaacttagatgtgttaaataaactgggaaaagagtttgataataaaattttcaagcaacttgaggattatctatacacaaaactgttatttaaatagaagtcacaagcagagagcatgttgctatgtttcccagaaaccatttattaattgatatgaacatgagactagaaaagttttcctgtcaatgcttatgctatatgttaccacttagacggtaggaactttggtatcatcttgggctcttaccggtctgttatctttcccgtgcagttgtcacgaggccctgcaagttttacctctgcaatggtcctttaatttctttctttaaattcccactgcagctgccctagttcaagacctcattcttccttgcttgtactactaagctgttatctgagttctctcttctcttctgagccatccttcattgatcggcaatattatcttcctaaaacccttcccttccctttctaaaatgcttcctagctcttccctcttcccagtctgacagtggtgtctacttctcatacttctcagttcttaggtattcagagacactcccctttacgtgaccccttcttaggcttgccttctgtctttcctcccatctctccaggttgacagccttctctgaatgaactcaccgttactcccatgctttgctcttgctcttccctcaccatgcttctaaaatctttttgttctttttttgaccgattgaaatctttagcaaactaagtcgacatcagcccctatttttggctacatgtcctagtgagttgtccttccatggcagttacacaatttttgtattacttttttttattcgtgcatttgctcatgccacaggaatatggaagagattgtgtattcgctttttacttcttcctcagcattaacatacaacattttagggagtaggaactgttgaactatttgttgagtgaatagggtgtatttcaaatatagttatgttttctctaccttgatgaagtcatatcacagaccattttatcccttcaatggaaaccatgttatatggactattagtgataataaatggatcactacctggtgaaaaaatgtggtatttcatgacgtaagactgccagtctttttctgtctttgctccacttcgaccttaagatggtcatcaacccatttttttcaggcaaagtacatgactgttgtacctgctgtaataatatttcactgaaatctggcattaaaaagcttaagtgggcatttggagctccatgtattgattacagtttttaaatttgaagtaaataaacagcatcctttattacaaaccgtttccttttgacatttaatttaccctgtttacaacgtgaaatgtaaagtggcggcctgtcagtaaactaggctttttgttttagagcatcgaggattcggaagagtattatgaaacaactctttttgatgaagaaagtcaacttaaaaaataaatcgccgtgttccaaaataaaattgtgtcggagactgtaagtagtacatatttaatctgaaaaactcaggattgatgtaagcactggaatactgtatttgtaggaatatgtatcagaattccttaaatttcttttttttgaaacaactgcagcaagagttggcacttattcagttgtctcttcaacctctgttgttctgatgactgaagaaataacttgaacccatgttatatgatacaagcataactccagctacactaaaccacactgacagtgttttgataattcttgtacaaaccagtatacctcatttatcattaattggtttgttaagtgcaaaacctcgtttctgtggaatgaaccctaaacacagttatgtgagtagcagcaattgttcagttatataatggttaattaagttgtaacattaaagataatatacttttaggtgtggcctctgtgggtctgtatcagtctcaaaatgtggaaagcacgggcatggaagggtacatttttctcttttacggacaacaataaaagaagactatattatctgtgcattcttttgtatttactcattagcttaaacagcacattccaataaaagtatgatttaaaaatactctgtagccttatcaaaattactaaagtaagttaaagtctgtgttcttgaaaaactttactacaaatgattaagacaactgaacaagatatatgtttatcagtgctgagccactggtttgtggatatgtcatttccacaaagacatcaaaatgccatttaatttgttttggttcaccattcaatgatacctcccctgagcattgattgaaagtattttattaacatgtatgtatacttaattacttatgattacaagtatttctcatctgtggcaagataaattatgtagagtgctttgtctttcaagtttaatattcatggagtacatggaagtttaggtatacatggatctgaaaacttgaatcatcaatttgtctacctgtctttttgcaatgtgcaatttttacatgtaacaacatacaaaatcttcatttggaaacattttatatagtaagtatgaaattcagaataattttggagtaagtcagttaaacgtattcttttgcagagtttctgaaattgtgttcatgaatcattcaaaaccccatactcccattgggaggagaggagccacttcctctgatttttctttgtgattttcattttaattggccctgctataccacttttatcttttcaaggtttcccaagttttaaaaaaccaagttcatacagattctgtttttctacattatgaggggcatttaattcctaaagttgcagtttttgccctgaaaagttattaggggtgtgtgtatgtgtgtgtataatgtgtatatttacatatgtgtgtgtgtgtaaatagacatgaatttacacacacacatacacacacatatatatttagttttatatcacttatataggaaaaatgagtcctctgtcatgatccaatattggacattatgaggttcatttaattcctaaagtgcattttggtaaaggatttttcttttatccaaagcgtgtattgatatataagtactacatcaagtttctaagaagatcattatttgagaactttttcagtagtcacagaggcaaaataagcactccagaggtccttgtgagacttctgatattcatactgagctatgtaaatatttattctacagtggaaggacaagagttaggacacagtgtacttaatgatggaatggttgatatttatgccaccccttgctacctcagatgagtaactgcatacttgaagtcactttggcagatattctgaaaggaagaagtttttgctctgaaaagttattagggatgtgtgtaagtttgtgtataatatgtatatatacatatatacgtgtgtgtgtttgtaaatagacatgtgcgtgcacatacacacacactcacacatatatatgactttagtttttagaataattttcagtttacaacaaattgatctgaaagtcctgagatttcccatttgcccctgttctcccacaatggcattccccactgtcaatatcccccaccagagtggtacctttgttacccatcatgaacttacactgacacatcattatcaccccaagtccgtagattacttcaggattccctcttggttaccactttttagtgactatttttctcatgtcacctgtgcgtagccagtactttatttttcataaagagaacatttaatttatacttttttgtgaccatgaaattttaagtcagaatatcagaaacaagtcacaataaaacaaatgtaaaaatttacttctctcccagaaatggtaagtcaaataccttttactaaatacatattcttgaaaattgcagttagctcttttatagtctagttgatagattgaagcacatagtttcctttagttccataataaacacctcctttgaaaaatggctgacatcaagaacattatgtctcctaagattgtctcactcaacaactgaattattgaaatgtacaatcacaaaaatctaagtatgtctttataacaacgatgcactgaacaaaatttagaggtaacgggcaaagttagcttccaagaaaatgtgcccacaaaccagtggcaaatcgtttccttcagcaactgaaacccagaataaatgcagtctgttgcctctgcctgttggagaggggtcttcttacacctgagggaagtggccatctcgtctccctgatgttagttaaaattccatctgggattggcaggttagtatttttgtgcagatatctaaagaaagctgatctggccaaatcaaaaaatacttgactcactccttaggaggaccttaactctgccctgatttctgtgcacacaccagatttattgcactcacagtacaaaagctctgaggtgtaaaattaaaccaagcagtgcattgcattcttatccagatgaatcggggctctctcagtgctgctcaaccaaagcacattggaatcacttcttcttattcttatttgtaaaactgacagtgatgatggtatctgtgtcgtgggaatattgtgagtgtcagaggaaacaatgatggtgaaaagcttagacagatcatacatgtcaaataaaagttagctgttaattactgatattgtcatgatttttactgctatgtaatagttgtaaatatatatggggtaagtgtgacattttgatacatgaatacactgtgtaaagatccaatcagggtagttgggatatttagcacctcaaacttttatcatttctacctgttgagaatattgcaaatcttccaagtattttcaaatatgtgataattctggttaactatagtcactctaccgtgctattgaagactaggactcatttcctctgtctaactgtatgtttgtatctgttgtccaacgttccttcctccctgtctttcctggtaaccacctctggtaaccaccattctattcactacctctataagatcagttttttttagctctgacatatgagtgagaacacgtgacatgtgtcttcctgtgcccggcttatttcactaaacgtagtgttttccagttgcattcatgttgctgcaaatgacaggatgtcattctttttatggctcaataatattccattgtgatatatagtgcatttcttttatccattcatctgtcgatgatcacaggttattgggggacctcacccccaatatttcaacataggttctttctattttccataagtgtcggctggctgagaaataaagagagagagtacaaagagaggaattttacagctgggcctctgggggtgacatcacatatcggtaggactgtgatgcccacctgagccttaaagccagcaagttttcgtaaggttttcaaaaggggagggggtgcaagaacagggagcaggtcacaagatcacatgcttcaaagggcaaaaaggagaacaaagatcacatgcttctgaggaaacaggacaaggacaaaacagaactactgataagggtctatgttcagctctgcacgtattgtcttgataaacatcttaaacaacagaaaatagggttcgagagcagagaaccggtctgaccttaaatttaccagggtggggtttcccaatcctagtaagcctgagggtactgcaggagaccagggcgtatttcagtccttatctcaacctcataagacagacactcccagagtggccgtttatagacctcccaccaggaatgcattcttttcccagggccttaactattaatattcctggctaggaaaagaatttagtgatatcttccctacttgcacgtccatttataggctctctgcaagaagaaaaatatggctctattctgcccgaccccacaggcagtcagaccttatggttgtcttcccttgttccctgaaaatcgctgttactctattctttttcaaggagcactgatttcatattgttcaaacacatacattttacaatcaatttgtacagttaacacaatcatcacagtggtcctgaggtgatgtacatcctcatcttatgaacataacaggattaagagattaaagtaagacaggcataagaaattataaaagtattaattttgggaactgatacatgtccatattaaaatgaaatcttcaaaatttacgttcagagattgaagtaaagacaggcttaagaaattataagagtattattacggaagtgataaatgtccatgttaaaatgaaatcttcacaatttatgttcctctgccgtggctccagctggtccctccgttcggggtccctgacttcccgcaacaacaggtcgatggcatcatttggctattgtgaatggtgctatgataaacatgggagtgtagatacctcttcgacatacttattcctttctctgagatatatatatgcaaccgtggggttgctggtccatatgatacttctagttttagtttattgaggaacatctatttccatgatggctgtagtactctgtgttcccaccaatagtgtaagagctcttccctttctctccatcctcatcagcatctgttatcttcaacctgtttgataagagctattctacccagggtgagatgatacctcattgtggttttaattggatttgcctgatgattgatgatgttgagcattttttcatataccggttgctcatttgtatgtcttcttttgagaaatgtctattctgatcttttgtccattttacaatcagattattatgactattattttgctattgagttgtttgagttcattatatattctggttattaatctctagttggatgtatagtttgcaaatattttcttcagttctttaggttgtctcttcgttgattgtttcttttactgtgcagaagcttttgagctccatgtgactccatttgtctactttgcttttgctgcctgtgctttggacggcttactcaaaaaatctttgcccagaccagtgtcctcaagcatttccccacagttttcttctagtagctttttagtttctggtgataaactatgagcatgcaggtgtgactccatttgccagtgtggtggactgaagttgtgaggacagaacggtttgtattttcataagttttcttatgcaaagttgatttgatgacagtggcctacaataaaaacactccttaatgtggcagtcttcagtaccatataaaatgtgcaaattagcaacatttctgtctgagtttggagctacaagattcaagtgtggagtattatattgttcccttccctttaatatttaatggaggaggtacatttttgcctgtaaagagatcaactcatgtatctaattatgtattaggaatatggggtcatttccttctatgtggtaatatattcacatatgggggaaatgccataatatatgggacaacaagatggataatattgtattaatgattataataaaatgaataatgtaatatgaagaaaaaaatcaattcactttaaatacaggctagatactttttaataaaatcagtagtgcatattgttcttttgaatctttcagtggtgcttaaattaaatataaatttgaacactcagatttaccctataatccaacattgttgctcctcaaaatgaagacttcacaaaagtgatcattgaggaaccagaatttcagctacatccggtctaaagaagtagggcaatcagtagctaaggggtttgtcaatcacatttctgaatggggaggatagctgatgctgtatgaagcacagatgatgcagacttatctacaggcttcatgcatctccaccttcagttccatgatgaaatcactgtctggctatactgttaagtggacagtgctacagagcaacatacgctcacaccactgcgagatcaacattagcacacggacagggcaggaaagagctttccggtggcatctatcacatttctaatacagaccatcactgaggtgacagaaactgttactctctatgtgcttccgtaaggcttgaataattgttacacaatctcggattgtgtctcaaaaaaaaaaaaaaaaacttgttgtatagacgggtttcactatattgcccaggcttgtcttgaactcctggcctcaagcaatcctactgcctcatcctactaaagtgctgggattacaagcatgagccaccaccatgcatggcaaagagtcacataatttaataaacacacatacagtgattgtaccagggtggaagttgcaaaggctctggagatgctgattagaaggtttgcaaagacccattctacttgtcaaagcaaatgaccccagaagtgaaggggtggagaaatagactctccttttgggtgaaagacctgcaaagaatctgaggacatttttaatccacttcagggaattaaaaatcgcttacacccctgcccagcccaatcccctcagaagcctggacaaaactgatggcttttgacgagaggaccttgtcatcttccaggacctcaaagtcaccaccctaaaatgggatttcccaagtgcactttccaaagtgaaagagcagaaagaaatacaacacaatagacacctgcagttgtaacaaatgaaagaacagcttaaatggtccctgcaatcttcacatccttttgcaattcccttcccttgtatgtgggctggtcccagagacctggagacttgattctaatgcacggaatacagaaaagttggagggatgctgcttctgagattaggttactggtttgctcactctcacttcctcatttgctcatctgattgaagccagatgccattttataagctgttctgaaaagaatcccatgggtcaatgatctgagagaagtccctagtgaacagcctacaagatgcttagtcctgccagtaaccaggtgagtgagtttggaatcaagtcctcccccagccacacgttcagatgagactgcagccacagccactactttcagtgcagcctcatgagacactgctaaccagaggcacccaactaagccacattcagattcctaacccaaagaaactgtagaacaaggttagattgtactaaagccacagaattttagggtatctgttatgcagctgtaaacaactattaataaaacagatgggaaaaaatacagcaggcaataagaaccaaaggaagaggagacggctctataaaatgcagaaagtttatattgagtcaaaataattgtcatggataaaaatgtatataaaatgattaaagttactacttataagaatgatatgacatttctaagctcatttgtgcttaataaaacacacctaaaattcataaaccaagaaaattcaaaactacagacagaaattaatatatatatataaaatcatagtgtgagtttttaacattcctctctcaattttcaacaaatcaaataaataaaatatcaaatgttgaaattattttaaaaatgaaattaaagcatgtttcattaactagatcaatgctgccacttattagagaaagtaagctcatatggggcatagaccacgacaggccatgtgctaggtctgggaaattgcagagagttgctatcataaggatcattttttcaaaccacaaaaatattttaagcttataacaatattcaaacatttaacaatatacctattaataatagcttacaagtcaaaaagaattcattagggaaatcaaaacatttcaaagtaaatgctaaaaatactacacaaaatattaacataatccagaaaaagcagctcggagagaaaaatttaagctttaaatgcataatctggaaaataaggaaacttacacactaatgatctcagtgtccaattaagtagttataagaggtacagaagaatatttccaaacaaaacagagatgaggatatattatgatgacaatagaagttacaaaaaacagacattgaataggaacattaaaagaagagtggatctttaaaagtactaatagaatagtgttcctctatgtggatatgttctagaatttcaaactgactttgaagaactcaccagaagtgaataggacacagccacaaatggatataactgcatttagaaaacggcaaagaccatggaagacatacagcaagcacagtaacagtttaaggaagggaaggagagagagggacgacctttctatgagggagcaggatagaggtgtgccctgaatttgaaggacaagaaggaatgagatatgcagagatctagggaaaggagttgtgaggtggggtgggtgtggagtaacagagagtcccaggcctgtcctcctggacggccagtggagtcatgcgccattggcagagaccagaggcaaagagaatgatgctgtgtggatgctgggaagcctatgggtcttccctccggattgtggatcccttgagaaaagcagggaaaaaaagcagaaaaaaaaatcttaattttctctaagatacacacacacacatacacacacacacacgtatacatgtaaacagttgtttaaaaacaaggatactacagtgcttaaaattaaaaattaaaattgcgacccttcttatccacttttgattcttgctccccagatgcaaggacctttttttgatatttaactccatattttaaaatcaaatgctttcatccaatcacttgaatttttaggtttagatcttatcttttgaagatgattcagcttatgaatgtgactcatcacacatacactcacacactcgcacacacttgcacactcaaatacactcacagactgtctcacacacatctgctcacacacacacttgcactgtcacacaaactccacacatttgagacactagcattcacacactcacattctctcacacacacactcttacacacattcacacactcacattctctcacacacactcttacacacattgacacactcacactcacactggcttcacctttccccaacttagttacatcttattttgtggcagatgattattacatatttatagcatcatgattatgtaaatagtgctcttggctagaacacacaatgcactataattacatttcctttaatgaactttgttttcttcagcagtaatcatcttgttgaaatcattttttttttgcccgtttttaatgtgcttaggactggtatatcttgcaactcccctgcagatgcacacttccccgtcaatgggtgtccccttgtctgataatttctttcttgcgtgttcatgggcgccactctgggatccttcgtcttcaggctcagtttgagcacggtgctctctgggctgcttcactgctggtgtcatcgccatcctggacggcctcttcctttccttcctgggtgaagtcactgtttcttggagctacttggtttatagatgtgttttgttaaatcatatactagagtactctcccccaaaaaggtgaatgggtaatacctgcttcaagtcgacatgcatgtatgaaaatgcctttattcttccctcctacatgaacaaaagttgggctgagtagaaaatgctatgtgagagatcttttcctctagacatttgaaggcattatctatctcctagctttcaaggttgctgttgagaagtttgacagcatttagattccccaacactttgaatgaacctgatttttcccactgaaaaatgatctcctacttgcctcattaaagtttagtaatgatggggctggtttgggtctttataatcaattgtactgaagagtctgcagaccccttcaattaatttattaaacacaaaggtatctaagttttaccatgcgtcaaacattttctgggtcctgggatgcagacagagcagtgttcttgagcatcttaccctctagcagggaggcagaaaatagacaataaacatcatgcataaccaaatggctttgtgatatgttttatgaaattaaagaaaaagtaaatgagaatgcgagagacaggggtagtgggtgggtggttgcaacatgaaatgatgatgtgagggggtgaggaagccaagagttggaaatctcatcctgggaggaatgaagagccatgcaaaggctctcaatcagcccctcatgctgccataacaaagtcccacagaccagggacttaaacagtaaacatttattcctagcctttctggaggctggaagggccagtgtcaaggccccgtagggtttgttttctggtgagtgcctgcttcctggcttgtgggtggccaccatctcactgtgtccttgcacagtggagagcgagggacagccaggtctcagtgttcatccttaccagggcattgatgccatcctgaggctctgccctctgagcttgactaagcttaagttaatcacctccaaacgcttcatctccagatacccttccattagggatgagggcttccacagatggattttggggtacacttttcagtccacagcaggctctgaggtaagcatgttcctggcatgttgaagaaacatcagggaattagagtggcaggagtagactgacagctagggagagtcgtaggtgatgaggcagacagatcacaaggcccttatccatttctggggtggggatggggtgctttggcttttcatctgagtcatggagggacccaagcaggcctctcggcagagcggtgatgatgagttaacacagctttacagtcttactctcactccagagttaaggacggcctgtatgagtgtagaagcaggaaggcctgttgggaatatccgtagcagtgtacacgagagatgaggtgggtactctcggtacagcagcagcaatgaaggagagaaacggtcacattctgaatacctcctgaagggagagccagtgggacttcctgttatattggaggtggaaagagaaaagaaaaagaggagtttaagatgattgcaaatttttggtttgagcaactaaaaggaaagacctagcattgctgagatgagaaaggctgtggtgaagtggaatttggggggatggtgaggcatctaattttatacattttgagtctgagatgacagacatccagaggatgtgacaagtgcagctggacagattagtctgggattaggaggaaagttctaatctgcagacatagagtcctcaaagtagggatgatcttcaagacctcaccctggatgagagccacggagacagtgagtttggacctcagggagaatgtcccatattcaggcactcagcatttaaagctcaaagagaagaagaagggccagaacaggaggctgagaaagagcaatcagtgaggcgggagggagaagccaaaacaagcaagaaggagtgaggtcgggaagccatgcgaacacagcacatgcaggctctgctgtgagagcaaaccacatggcacctgagaactggccactggtctagcaatatgaaagttactggtgactggatgcctcactgatgtcagtttagaagagaatgagggacaagcaacagataatcatctttgttgcaaaacagtaaaaaatatgtagtagttggtgggaaaagtggggtcaagagaaaactggacaggtcttattttttcttcttcttcttttttttaaatgacctctcctgttctccatttctttgtgctcttagtttctgaaagtttccctcagaattttattgaacccatctaatgaaggtaggtgttctaccttggcttccagaatctccccagcaggtcaggttcaagttgcccctggtggtaactggcttgatgatacacccattcctggtgccttcttctccctgtctcacttgcccacgtcgctgtaggtgttcccttcaccttttgaataagctagttgcacttgaaccctctccttgatgaggctccaaaccaagacagtctgctaagtcacttttgcttagtctttccttccccatttccaaaattgtgttgtccctgtctgttccctttgttgtgtgggcttaggccttttgaaaagtccttttactatgactataattaggctttgagaagagaaagagctaagtgagtgtgtcaaatttgccatctttagccaggagacatttctcaatcatcatgatatcagcgacctcatcaaggagaaagaaacacagttctgacctgtcatctgtgattctgcaaagtttactggagtctaaaagttggtctccatgccaaagttagctttgcccaggtatgacagtatttcatctttgcaggccgtaaataagccgtgagcacttaccgtcagtgtgggaagtggacggatacttgaggctgccgaaaccccactgccagcccgttcatccttggaccgtgaagccaccctcattagcactaaatgcaacattgccatcaaggtcactcgtagacacttgagtttctttatcacctgcacaacaccaagcaaaatgaaaagaccatcttctcaaatcaggatctggtgaggctggtgttgccctgatggttacattagaacggactgaattgttttcattaaaatgcaaccccattactatagatgagaaaggaactccaccgagggagatttcagatctatgttttgtttcactgaattatggaaaattaacatgcttctgtcttcactcctaaaggtaataacactctctcaatgggaggcatggagcgcatatgattaggcagcctggaggagtgaggcatgtgtctaattttgctctcaacaacaacaacagcaacaaaaatacctgttcattaaaagcagagaagagatatttatatatcaaattagttcttttgatttaatccctggagtaaaatgtcataaacaggtattaatttgggtctgtttactaaaaatttaatgcctgcagaaaatctatttgaatcatcacaaatgtaatattgtctaccaagatgaaagtggggaattatagcagcaatttgggatgaaacttgagtgtactggagctggtgtgtgcccaagcacagactaattaatgtctgtgtgctgcccaactcgcagattcacactcagcagagcatcaattagaggggtcaacctaatccacatgccttactaaagcaataaaatcacttcttccatttctaaatattattgctgctaatatgtggcccttaaatgtgtgttcttagctctcttgatgaaagggattaattatcaggatgattatttcaccatatgattttgttgctctgcctgataaaacaaaagacatttcctgggacaagaggagggatagccaataaagtcattctgtgtaaacaccgcagcactgaaaccaacaaacggttgtgtccatggtaatgatgtccccagagaatggcattgtggggagtatggggacctttgatccaggctccttagccaagcaaaagagaggaaaggaattttgttttttcagatcattcaaaggcaattccagaccccccctattgctcctgtgcttgcaatatttattttctttgagtattccaggtattacagtgtttgggtcaaaagaccagagaaaatggccttaattttgtgtttctttcagctaactagcttgtaagtgttaatttcaagggtttgtgaagtatctgggatacctaaagtctctctgcatacctggcctcccatttctgccacagccctgcaggggaaatcagggcatctctatgttaccaatgaaaacattcacatgcagaaatagtaattggttctctaaggccagagagttggaaatgtttagccaggacttgaacagagctccaccccattttcaatcctgttttcttttaactgtactaagttgtctcagtctacctaaaacacctatctgaggaacaacatccttcagagtccagggaattggggccatggcttcaggctgtggtcagcccttatctaggggaatcttgcctggtggcttagagacaaagctgctgccccagcccatgggcagtagggtggctcactgaacagggcatcagtagcttcctgtccacatacaactggggaagagtgagctttgttcctcttgaggctgagggccagaggccttggaatgaaaccagggtctcagatttcaaatccacctttgtccactgggccccttcctgagcaagcctctcagtgtccaggggtccttgggaagctctgtgctgtgcccagggcagctggctggctgtgtggcctgttgtcttgttggactttttccaggaagaggatcatgttcccatcccttcacctgaaactgcccagtggagctcagccccatccctctctctgagattggagtgtgtcagggatttttttttcctttcttgtttcctttctgttgtttctagagacacagattcttttctactgggctgggagccattcctctaaccctgacgtttagcctgaagcctttgctttctccttctcagagtagtcctttgaaggccagcctgctttcatctgtgtgcaccatgctcagatgggcttaaacaaccccctacagtctcagaaatttcaagattttctgctcagtttgggctgcacagaaaccaaagaccagtttggactatctactcccaaggaagattgctcattgctgacataaaaccaagagatttttatcagaattcaatgccagctaggcatagcttagcttcgtaatatgaatatgaaaaaagaaattttaagataatttatgatagagccggtacagtgattctaagattcattagttgtcatggtacccctccacactcacatgcacatacatacaatcataccctcaacttgggcgctctaaatatggaaagttcattgtaggaggttcctgggtggggagaccaagctccaagatgacaagctcaatgacagaataaatcattgtgcctcagtcttcacctccaagtcatagcatttaataccatgactgatagatggcaagaacacaacaactgatgaatcaaaaaatgaatggacaattaaaagaacaaaatagaagcagaagaaggcagcatatctgctgctttagaccttcatgatgttggccaaattcagccacttcgtttccttcataggatctcatggtgatgctgtgaatcctctctaaccaaagcccttctagtcagatatcttaaatttattgtcaataatacctttcatttacttacacaaaagcttctataatgtgggtccaactgttgagctgttgtgctaggcctgaaataaatatgtaacaactcttatattttgaagttgtctttaatttggcactggaatctcaattgcagcacaattgctgtgacttcagagctgtgcatctccttttgcaaaaacacataaataattaaagaaaaccgaaagaaagaaacaagaagccagcactcacatcttggtggtgcattgaagcccacatgtaggagctcaggagagccaatgataaggtcagtgatgcttcgatggtcactcaagatcagccatggcaggggtatttacaccaggggaatgggacagaggagagtgggtaagctagcacagcttcccagatcccacctgacttctcccttcccttctctgcaggatctgcactcctcaatagacacatggtctgcagcagttgttcccaacctttttggcaccagggactggtttcatgaaagatggacaggggtggggaggatggatttttttttccccattgactgggggtgggatggttttgggatgattcaagaacattacatttattgtgcactttatttctagtattattatgttgtaacatataatgaaataattatacaactcaccctaatgtagaatcagcgggagcctggaacttgatttcttgaaactagattgtcctatctgggaatgatgggagatagtgatagaccatcagacactagattctcatgaggagtgcacaacccagatccctggcatgtggagttcacaacagggtgtgtgctcctatgagaatccaatgccacctctgatctaacaggagatgcagctcaggcaataatgtgagtgatggggagtggctgtgagtacagatgaagcttcacttgcccaccactcacctcctgctgtgtggcccagttttgggattggggacccttggtctatagaatgcctggctcaggtagacacgatgccatgcttcctattgtgcacgttgcttttggtcagcagtgcaggcagagaaatgcaggctgcaatggttgtttatagtagcagaacacaacagtctgctttctgttttggaatcagggtcttgggctcagctcatgcactggtgtactgactcctgtttttgtttgtttttttgtttgtttttgagacggagtttcactcttgttgcccaggctggagtgcaatgacatgatctcggctcactgcaacctccacctcctgggttcaagtgattctcctgcctcagcctcccgagtagctgggattataggcatgtgcaaccacgcccagctaattttgtatttttagtagagaccaggtttctccatgttggtcaggctactctcgagctcctgacctcaggtgatccgcccgccttggcctcccaaagtgctgggattacaggcttgagccaccacactcggcctcctatttttaattaaaagggtaaattcagagagaacatcagtgaattggaataaatgtgttcatttctctctagacagaaggtccctgtgagtcatggtgcactgagctggacaacaaaacctcgcccccagtgttccagggggccatgtggatgggagtaggaacaaggcctggggaccccattccttgagctcaactcttgaccttaccatcatcacagcaagtttctgaaactttctgcacctcagtttcttcacctttactgcggatgtccaggtagcacctaagagatgagtttgtcttgagtgttaagggaggagatacacctgaagctcttggtaccgtgcctggattgcaaatgtgcttccttaatgatgtcagcagttgttgttatttttctttgccattacaatgttataccaatcctatgggatgttattgttttaaaactgcctgtgagtattataaacaatatcaacaacaaaaccaagaaaaatgccgctctctacttcccctgtggaaaaccacaatggccgtaagtgtctgaacagttgaaaaacctttcagcagtgagactggttaactttaactcaagagttttgcaaacatacttgaataggcacctatcagctgctggggctgggaagtatggttgcacccaccttactgtggttggctcagcttggaggagccctgggagacctgcagagagtgtgggtgctagagccttctgcagggctcaggacacattccccaacacacccagggccaataatttgcactgggatacagagaggaggctcggggcctctgtcaacagattgccatccacttagatgagtaaatgggtaagaacctcctcgggccttcctgggagacccggatgtgtgaggaccgttctgggcccttgacccctggtgtgtctccacagtgctggccccgtggtgtggtgacatctgtctgtctgtctggtctagcatccagcacagtcctgggcacatgaattggtgctgatgctgctgaaggagtgaatgcaggccagaaggaaggagtgctggggaagaagtgagccatggagcaggtgggtcagggggcagggcagtttacctgaccaagctcgggggagaaggcagcttcagagacaggctggagggagggtggaaggaggagagtccttgtgcgaatggtggtcgcagatagcatggaggcttgccccctgcaaagccacccttgggcacaaagaccagggagagagaggaatgcaggaatggggagtgaggggctgctgagatccaaggacctggctttctgcctcagaagcttggtgtgcagctgggaggggccgagtgcagaaatgctcctctgtaaggatcaggactttagcagatgccagcaaatccacttgcacccagagtaggagtgcagagggaggcgatgtggtcagaggtgaaggagagagagcaaggagcctgatcaggaatgagggggcgtggtcaggagtgagggggcatggccagtgtgcggtgagtgagggggcgtggtcaggggtatcaagagcgaggggtgtggtcaatgatgaaggagtgaggtggtgtggtcagggatgaggagagtgagggggtgtggtcaggaatgaggcgagaatgaggcatagtcaagaatgagagtgagggggagtggtcaggagtgatgaaagatgggggtgtggtcaggggtgaggagagtgagggggtgtggtcaggaatgaggcgagaatgaggcatagtcaagaatgagagtgacggggagtggtcaggagtgatgagagggagggggtgtggccaggggtgtgggtccaaaatgaggaaaaggaaaaaccaaataccagaagaaaagttggacccagaaatcgcttttttacaacaagcagccgttctcggaattttgctcagtgcgtctgtattcagggagcgagaccctgggggaagcctgtgcaggagacagagggcagccccacctcattcttctgctggtcactctgtgctcaggcaggaaccacggacagaggcctcccagttcactcggggacatatccgcagatgtgagaactcagagagatgttcaagtttcctaagagggcttcaatcatggctcacaggtgacacaggagaaatccaagtgggcttctcaatttgttaaacttgtttttcctcctcatatgctttataaacaaaaatggaagaatttaatatatgtacagagcagcaaatgttctctccctgttgctttcagatgttttcctcttatgtaaacagtgttgatgaaaatataaataccatcattccaccttcatgttaacaatcttattatcttgcatcaacagaagtgaacaaatatgtacatgacacctatcaattcctttttaaaaaacgtatttctaaagagtggaggaagaatttaatgaattcaacatgtagtttacctgcttatattttgaaggcgatttaatcaagtaaaaccaaattattgcttaagttgtgtcagatgtacaacagccatcaacactctccatgctaatgcggggtaaggggtgggtggaactaatggcaatgggtccaagtcctctgggtcaggcgattaggggcttggcaggctggagagaatgtttagatgctggggcaggatatttcaacctgctggtcaggtaagagatatttgctggcagtgaaaggaatattttttgtggaacaaattgctaggaagaggtcacttggggggcattagatgagagaaatatcaaagccaaactccaaatcagtctaagggggctaaggaaaacggaaatcactactgattccatctcctcattggtttcgcttattccatagcatactttctttttccatcttccatcacttcatattcttttctcctccattcttcggggttttttttcttctacctctttgtaacaaagaagcatttaggaacaattttaggagacagtgagacaaaaaaataatttagagaagacatgataatatactctgtgtgtgtgtgtgcgtaaaacatattaatatatttgatttgccaagaaagataaactgggatttttgagatttaaaaaattcatcatggccaggcgcagttgctcatatctgtaatcccagcactttgggagtccacagtgggtggatcgcttgaggccaagagttcgagaccagcctaggcaacatggtgaaaacctatctctactaaaaatacaaaaattagccaggcatggtggcgcacacctgtagtcccagctactcgggaggcagaggcacgagaaatgctggaacccaggaggtggagattgcagttagccaagatcacaccactgcactccagcctgggcagcagaatgagactctgtcttccaaaaaaaacaaacaaaaaagccatggtatgtctggttatattaatctccaaaccagctagtgtttagtattgctagagctataatagaatcaggaataggaaacagataggaaaaaaaggaattttacaaggatttatatttgcaaagaaaaaaggacttatttagaattgtttgttgaaattcccccaagactattttttgaacttatatatgtagacaacaacaagaaaaggagcttaggagttctcacagggtttaggaactactagaccttgtgtattatgttcatctcagcactcaagcaagtaaaggataactagaacatggtatctcacagtgaataacatggttggttactttactaggctgacatatggagatagggcctataggagcagggcttttcttatgaataccagagagacacccaggttcaactgcatgtacagtgcatgagggattagctttacagtgttatctgcaaagtacctaaaggtgttctctaactaagcaccaacttcttagcctagtcctcttaggcacacacaaaaaaatatctaatactaagcttataggaatactttatttggtcacttggtgggggaaggttgctgagacatataacatttaatacctaaaggtaggaggaagcaaggaaagagaaaatgcagaaaggaagagtaagagcccaaagaagggtgccacctctgtagactctctaacagaattaaattgacaatcttaagataacagaagtaaaagggcatgccttgagggaagcatcaatacacttttggaatctgaggcaaaaagtgaaatgatttacctcttgccaagtctattgtcattgccccatgggaggttcccatttcttctactcttgaatgcacaagtaatattccttgcctaaggattagcatgctgtgataatggtggtaatgacagctgccttaaattagtggcaaattcagaatgaaacactgaccaccaggctatgtttctgaatccagtctatgccctcgaatgtattcaatctactttctgtggtatccccgagagctgtggcaaaagagttgtatggtaggggcaggctccttatgggggcataaatggcttcagaaaacaagtattccatcttctcaccatgactttttggctttcttttttttttctcttttctcccagactactaatttccagtttcttctctaccagtctggatgcccatggtgaactttagagatatccatcagctccatcaattccctcaactacatctacctagcttttgagcccagaagaacccaatcatgtgtgttctcctcagctcccaggctgctgagcaatgctggagaaaaatcacaaaactatacagtttggtatctctccagaattatggtttccagcttgagttggaaattcagaattacttcaaaatgtttaaatttgtttctggtcagtttcctccttcatttcccagtttcatttatcactctatttaacttgttacccatcgctgtctgctattaaccttgcctccttttacacgagaaaacagaggccatcaaatggcatttcccatcactccatcactccacctctgtcaatgaatccaccagtaacatctcagagatccttctgtctagcactgatgatcttattgtatcagttactccttcttccttttgtattttcaatgctcctattggccaccaacatgctttagctgttctcatctaaagaaacaataacaaccacaataaactaacaaacaataaaccatctttaacagaccttaccttttcctcttttgcgccaccttcaagcttcctaaactcagatttattcctcaatccattacaatctggtttctaattaaacaattttttgccagcatcaccaaaaacttctgaattgctagtctccaaggtcctttcttcaacctcattgttttctttcttttaaaagtcaagttcactgaagtataatttacgtacaataaaattcgcccttttaatactcttttaccatctaataagttttgccttgtatgttggttccctgagacctgtaaaacaactcccaaatcccaaacccctttgcttcatacacaaatccctttggaatgtctcagcagatataacacaggttcaagttctttcttcagtcatcagagtaacagaggttgaagatgcaatcaaataagtgccaactcttgctgctcctgtttcaaacaaggaaatttagataattgttatttcgctgaccccacgtttactacctgggaggtagaaaagcctggggagcaagaccatgccaacctaagtaccacacagagagggagcctccctataagaagatggtattcagaaataggcactgcagtggggacgcgtgcgccctagtgaactatgtgcatattcaggcaggggaaggcagacaaaggtttttcaggacaagtgaagaggattacataattgttttgacataatgatctttggctacaaggatgaataacaagggtagcattggtcaggggcttggacaggaagttgctgggcaggtgtcctcacagaagtattatttgtgtcaggttgcaacagcctttgtgcaaatttgtgggttttgcagtcttccgtgatagcttttgttatcaggcattcgtgcatgggaaccctgcctaggtggccctccacagctctatttgtcaggtttttggatttttgtttgcttgaacaacaagtgactccatcttgattctgaaacctttcacaaccatacgggcaagccaaagtctaattgtgaggcccactccaatgcgacctgcttctgggcaacgtgatagactggccatggcttatatcacaaaaggagaaaggcttcgatcttgacgctaggaactttctcctggaaacgggccgatgacgcctgtcatctgcgagatgaggaggaaaggagcaaaggagattcacagaagaggaaccaggaacggccagtgagaggatgcacgacctcgccaccgctcggggaaacgcaaggcacacagcgatgaggtggtgtctctccccgtgggatgggcaagcaggcgaggctggacaggaccaaaggctgctcgggctgtaggaacccaggaccgctcccacgctgccagtgcgagggaacatgggttcagccacgcaccggaggtcacagatgagcaatgcttggttgtggcgttgataggcacagcccaagtcccagcagagccactgcctgctgtgcaccccagagtctttctggctgacggtggtggctcagacaggcatgcgggatgccactggcagcagtgtctgcaacagccaaacagtgggaaggaccggaatgtccatccccagggtcatagacaaatactctggggctgtgattcagcaaggagcttgggcgagctggacgcttgggggaaaccttggccagcaagttgccaaacaggaggtcaggcaaggaaagagaaggggatgagggaacgacacccagaggtgtgaccccgtgggaacctgtttgccacctgcctggtggagatgctgttcacatggccccagcctcccatgatgggtcaggtgcagggtggtcagatccacgggcgcagaatctctgttttgagcggaggctgctctgccctggcgcagtgtctagccccggcaacagaggactggggaaggacctatggaaggctgactcaggccctgacagacggaggtctccagggaggtacgacacccatgctgccctcagggccaagagagcaatgtcccagagcccatcaggctggtgagggcacagggggcaggggacaaattgagtagcccactccgcgcggactacctttccaggcacacactcaggcagagacccagactcgggacttgcggctgcaaaacggacgaggcccgggcatacttgggtgctgggtcaccctcctaggtgctggctcctggcaccagggcagcaaagtgcttcggccggagggctgcgggtccctgaagccggatgggcagcggggagatggcagaccctccgtaggatggtgtgcgtgagctgcgtgagcgcctggggcatctcctccacggaatggcacccgcaccaggtgcccctggcctcgcctggccttgccagccagaggaccagtcctggacggggagggggaggacaagagcaggtgcacaggccccagaacccggctccctgaccctggccagaacgcagagctgccggacgcacctcagaccactccctggccctctggtgggcacgccggggtgcacacccgtcgccccgctggcgcctgcctccggggcacgtgcgggaggggcagaggcctggaccaggaaccgctgtggtgagagccaaaggcgctgggacctgcggcccacagacctttggacaccccggtgggggtgggggtgggctggcgcctgtgttcccgggacccgcggcgcgaggggagtgggggtggggctaggggataggagcaggtgacgtcacccggggtcctggggcgctcgggaaggcggcgagagccaggccacgtgacccgcccgcggcaacggccctgcgctctcccgggccggcgacgcggaggggtccgcgctgcaccgccgccgcaccccggccgcgtgaccgcactgcagagagcggctgcgagcaggcgcctgcgcaccggcccaaacgccgagcgagcgagggagaggcacagtcagagggaacgcccgcgcggggagccaggggcgcccgaccccgccgccgccgcagcggcgcgcagcccccgacgcgccctgtggggacccggaccaggagggaccctgccccgggaaaaggtatcagacccacccggggagggggacgctgggtcccgggagactccgccgcccctcgcctgtccgccctaacagaactgaagcagcctgcggggcagcggtccggggtccggggtccggggtccggggtccgggggcggcgcggggatgaggccaagacccgcagggaccacccccccgggggggcggggcgggacaggggcggggcctggctgcagaggcgcggccaggggaggagggcggctgggggtgggagtggacgtggacgtggacgtgggcgtggggaggggtgggcattaacctcgctctcgcccgctcgcattcacaggctgtggagacctgggctccgaccccagttcatccccccacacccccgccgccccgtgccaccctggtccgcgctgggaaccctatcctgcccctcgtgtcagcccggcactggccagaatcgcgggcatggcggtgaccatgctgcaggactggtgccggtggatgggggtcaacgctcgcaggggcctgctcatcctgggcatcccggaggactgtgatgatgccgaattccaagagtccctcgaggctgccctgaggcctatgggacactttacagtgctaggcaaagcgtttcgagaggaggataatgccaccgcggccctggtcgagctcgaccgggaagtcaactatgctttggtccccagggaaatccccggcactgggggcccgtggaacgtggtctttgtgccccgttgctcaggcgaggagtttctcggtctcggtcgcgtgttccacttcccggagcaagaggggcagatggtggagagcgtggccggcgccctgggtgtggggctgcgcagggtgtgctggctgcgatccatcggtcaggcggtccagccctgggtggaggccgtgaggtgccagagcctgggcgtgttttccgggagggaccagccagccccaggggaggagtcctttgaggtctggctagaccacaccaccgaaatgctgcatgtgtggcagggggtctcggaaagggagaggaggaggaggctgctggaaggcttgcgtgggaccgccctgcagctcgtgcacgcgctcctggcggagaaccccgccaggacggcgcaggactgtctggcggccctggcccaggtgtttggagacaacgagtcccaggcgaccatccgggtgaagtgtctgaccgctcagcagcagtcaggcgagcgtctctcagctttcgtgttgcggctggaagtgctgctgcagaaggccatggagaaggaggccctggccagagcatccgccgaccgcgtgcgcctgaggcagatgctcaccagggcccaccttactgagcctctggatgaagcactgaggaagctgagaatggccgggaggtctccaagtttcttggagatgctggggctcgttcgggagtctgaggcatgggaggccagtctagccaggagcgtgagagcccagacacaggaaggggccggtgcccgggctggtgcccaggctgttgccagagccagcactaaagtagaggcggtcccaggaggtcctggtcgggagccagagggcctcctccaggcaggaggccaggaggctgaggagctcctccaggaggggctcaagcccgtcctggaggaatgtgataactaggttggggctggggaggcagcccagcgcgagtcctccccgggcaaataggctccgagggccccggggcctcctctcctcctctcaggcagcagggccctggagacaggcggaggccgggccagggccggtccctcaccccacatcgggatcggggccagctgtggcctgggtgggggcacctgaagatgtctgccccccactccttgtcctgggttgggagaggcagggggaaagaggccctctcaagggtgtcagctgcctgggtctcccaagagcggtcccccacccgcggagtcctccacatggctcccgtgtgggcctctgacttcatgcccaggccctcctggggctcttccctgaccttggcttccagcctgaggttacacatgtggccactctgacccttctgaaagccctgagcgccgccccccccaccccaccccgcagtgctgtcagggatcctggataccaggacctagcctactgtccctctgcctgtctgcaacgtccaaaccacctactcctgggaggtgatcagcgtgccctgggaacccaatcagcccctgctcaagactaccacgccatcccgtgcagcccaggggaccacacagaccctcagggaccaagcaccccacacaccccgatgttagcccagccactgtggcacctcacctcaccttgtccccagccaacactgcaccccgcaccccgcaccccatgcagtttcccacagcagaggcgaggccggctggaacactgaatgaaatttattgaagagagatatgtactgaaaccgttgaagagaagggaatcacaacacagaagctgcaaatggccaccacaggacacaggtcgggacccccctcctcctgggggaacacccaccccaggtctaggaaactcagtaacaagtaacaacaggggtggaacgccaaagcacaaagttcactggggaaactcagacagccccactccatcccgggtcctgttctttctcccacagtcatggtcaccatcgctgtcacgggatgagtgtccactgtgccctggtgccttctttccgccatctcccgggactgcgctggggtcctctggggaggagctgctcagagaagaacacacacggctccacaaaaacaagcagcccctggcctagatctacgcagggaaagcagaggtggtgctcacgatacgggagagcagtgagcacaacctgggctcccaggaagctcacagcacgtgcccctggcactggaggggcgcctccccccaccccatttggtattaaatgtggtcatctgggtcaccgggaaggtggtggtgggcagggccccttggggggaagtggggggccccgatcccgatgtggggtgagggaccggccctggccccgcctccgcctgtctccagggccctgctgcctgagaggaggagaggaggccccggggccctcggagcctatttgcccggggaggactcgcgctgggctgcctccccagccccaacctagttatcacattcctccaggacgggcttgagcccctcctggaggagctcctcagcctcctggcctcctgcctggaggaggccctctggctcccgaccaggacctcctgggaccgcctctactttagtgctggctctggcaacagcctgggcaccagcccgggcaccggccccttcctgtgtctgggctctcacgctcctggctagactggcctcccatgcctcagactcccgaacgagccccagcatctccaagaaacttggagacctcccggccattctcagcttcctcagtgcttcatccagaggctcagtaaggtgggccctggtgagcatctgcctcaggcgcacgcggtcggcggatgctctggccagggcctccttctccatggccttctgcagcagcacttccagccgcaacacgaaagctgagagacgctcgcctgactgctgctgagcggtcagacacttcacccggatggtcgcctgggactcgttgtctccaaacacctgggccagggccgccagacagtcctgcgccgtcctggcggggttctccgccaggagcgcgtgcacgagctgcagggcggtcccacgcaagccttccagcagcctcctcctcctctccctttccgagaccccctgccacacatgcagcatttcggtggtgtggtctagccagacctcaaaggactcctcccctggggctggctggtccctcccggaaaacacgcccaggctctggcacctcacggcctccacccagggctggaccgcctgaccgatggatcgcagccagcacaccctgcgcagccccacacccagggcgccggccacgctctccaccatctgcccctcttgctccgggaagtggaacacgcgaccgagaccgagaaactcctcgcctgagcaacggggcacaaagaccacgttccacgggcccccagtgccggggatttccctggggaccaaagcatagttgacttcccggtcgagctcgaccagggccgcggtggcattatcctcctctcgaaacgctttgcctagcactgtaaagtgtcccataggcctcagggcagcctcgagggactcttggaattcggcatcatcacagtcctccgggatgcccaggatgagcaggcccctgcgagcgttgacccccatccaccggcaccagtcctgcagcatggtcaccgccatgcccgcgattctggccagtgccgggctgacacgaggggcaggatagggttcccagcgcggaccagggtggcacggggcggcgggggtgtggggggatgaactggggtcggagcccaggtctccacagcctgtgaatgcgagcgggcgagagcgaggttaatgcccacccctccccacgcccacgtccacgtccacgtccactcccacccccagccgccctcctcccctggccgcgcctctgcagccaggccccgcccctgtcccgccccgcccccccgggggggtggtccctgcgggtcttggcctcatccccgcgccgcccccggaccccggaccccggaccccggaccccggaccgctgccccgcaggctgcttcagttctgttagggcggacaggcgaggggcggcggagtctcccgggacccagcgtccccctccccgggtgggtctgataccttttcccggggcagggtccctcctggtccgggtccccacagggcgcgtcgggggctgcgcgccgctgcggcggcggcggggtcgggcgcccctggctccccgcgcgggcgttccctctgactgtgcctctccctcgctcgctcggcgtttgggccggtgcgcaggcgcctgctcgcagccgctctctgcagtgcggtcacgcggccggggtgcggcggcggtgcagcgcggacccctccgcgtcgccggcccgggagagcgcagggccgttgccgcgggcgggtcacgtggcctggctctcgccgccttcccgagcgccccaggaccccgggtgacgtcacctgctcctatcccctagccccacccccactcccctcgcgccgcgggtcccgggaacacaggcgccagcccacccccacccccaccggggtgtccaaaggtctgtgggccgcaggtcccagcgcctttggctctcaccacagcggttcctggtccaggcctctgcccctcccgcacgtgccccggaggcaggcgccagcggggcgacgggtgtgcaccccggcgtgcccaccagagggccagggagtggtctgaggtgcgtccggcagctctgcgttctggccagggtcagggagccgggttctggggcctgtgcacctgctcttgtcctccccctccccgtccaggactggtcctctggctggcaaggccaggcgaggccaggggcacctggtgcgggtgccattccgtggaggagatgccccaggcgctcacgcagctcacgcacaccatcctacggagggtctgccatctccccgctgcccatccggcttcagggacccgcagccctccggccgaagcactttgctgccctggtgccaggagccagcacctaggagggtgacccagcacccaagtatgcccgggcctcgtccgttttgcagccgcaagtcccgagtctgggtctctgcctgagtgtgtgcctggaaaggtagtccgcgcggagtgggctactcaatttgtcccctgccccctgtgccctcaccagcctgatgggctctgggacattgctctcttggccctgagggcagcatgggtgtcgtacctccctggagacctccgtctgtcagggcctgagtcagccttccataggtccttccccagtcctctgttgccggggctagacactgcgccagggcagagcagcctccgctcaaaacagagattctgcgcccgtggatctgaccaccctgcacctgacccatcatgggaggctggggccatgtgaacagcatctccaccaggcaggtggcaaacaggttcccacggggtcacacctctgggtgtcgttccctcatccccttctctttccttgcctgacctcctgtttggcaacttgctggccaaggtttcccccaagcgtccagctcgcccaagctccttgctgaatcacagccccagagtatttgtctatgaccctggggatggacattccggtccttcccactgtttggctgttgcagacactgctgccagtggcatcccgcatgcctgtctgagccaccaccgtcagccagaaagactctggggtgcacagcaggcagtggctctgctgggacttgggctgtgcctatcaacgccacaaccaagcattgctcatctgtgacctccggtgcgtggctgaacccatgttccctcgcactggcagcgtgggagcggtcctgggttcctacagcccgagcagcctttggtcctgtccagcctcgcctgcttgcccatcccacggggagagacaccacctcatcgctgtgtgccttgcgtttccccgagcggtggcgaggtcgtgcatcctctcactggccgttcctggttcctcttctgtgaatctcctttgctcctttcctcctcatctcgcagatgacaggcgtcatcggcccgtttccaggagaaagttcctagcgtcaagatcgaagcctttctccttttgtgatataagccatggccagtctatcacgttgcccagaagcaggtcgcattggagtgggcctcacaattagactttggcttgcccgtatggttgtgaaaggtttcagaatcaagatggagtcacttgttgttcaagcaaacaaaaatccaaaaacctgacaaatagagctgtggagggccacctaggcagggttcccatgcacgaatgcctgataacaaaagctatcacggaagactgcaaaacccacaaatttgcacaaaggctgttgcaacctgacacaaataatacttctgtgaggacacctgcccagcaacttcctgtccaagcccctgaccaatgctacccttgttattcatccttgtagccaaagatcattatgtcaaaacaattatgtaatcctcttcacttgtcctgaaaaacctttgtctgccttcccctgcctgaatatgcacatagttcactagggcgcacgcgtccccactgcagtgcctatttctgaataccatcttcttatagggaggctccctctctgtgtggtacttaggttggcatggtcttgctccccaggcttttctacctcccaggtagtaaacgtggggtcagcgaagaaacgcatgtcttctgtgacaaagcagcctccccggttgggctcgtgtgtccagtcctccccgcccccctgccccccaccgcttctcccccttgagggccaagactgcttgttctcattcaggcaaactgctgctctttacctctgctgtgagagtgtctgtctatcgaacctttagtgttagacttgtcacggcttataccacatattgtcctctctcttgttttcagccgtgatttttctggagtccttcttcagaaagggcaccgaccccccccccctccccccccccgcctcggccgcccccgccctgggaacatctgtgggtctggtgtctccaactggcccagccagcccaccggccggctcgcaactaatttcctgttttcggccttgtctcttcccactctccttccttctgcacctgctgactccaagtccaggacgctgcaggacacccattgccccccgccaaccccgggcaaggctgggctgtgacacgtcaactgtctttcttttgtcagtcctctgtccccattgtctccacctctcaacacagttgactctccttccttctcaaaaccatttcctttctcagcttcttcctctcccccaccccacttttgggctgacctcctccctctctacctgcctctctgcccttggaccttcctcctcctcctcctactttgctggatctaagcgtggtgggggcgggctcccagcctcaaccctgggacatacggcacctccgatgaatgctctgtctctggacgtgacctctcttccaagctccgcacgtacccatccatctgcccacgtggatgccccgcagacatttcagagctaagatgttcaaaccggagggcttcgtccccttcaccatgcctacactgtccccgggcttccccctctgtgcaaagggctctgcctcctacctggtgactcaaacaaagcagccaagattctctcccctctcctttgttcctcactcccaaatctaacccatcattggattttgttgactctgctccaagactgctacccttctcatctccgtggtccttggcccgccctgcctcctgttctccctgcctccactccgcttcctccctgctccaccaacaccccctcagcagccagggtgatctttttgcaacaccaccagaccctgctcctccctgtggcaccccatctccttagagtaatctcaaagtccccatcctggtcaagagcaccccccacgctgctcctggggatctggcttcctctgatgctctccttccttccccgaaatccaccccatgttgccatgcccccagctcctctcaccacattcctgccgatctggcctgttcagctggccccaaagcacagggcttgttcccaccttcggcctttgccatccctccttcctctgtgtgagccatccaggcccaagaaccttctgtggcagcagcttcctcctgctcttcctctccctcctcctcctcctcctcctattcctcctcctccccctcctcctcctccccctcctcctgcacctcctcctccttcatgtctcagctgaactgtcccctcctcccataggccccctctggtgggacacacaaatcacgtgccctcggtttatattcttattggcggcatcagtacatgtgtcggcacgtgagaaatgctggtctgagtctttgcttttgggtatcaggggctccctccccaggtggcaagctagagccccagaaggtggggtggacttgcctgtgtgtctagcccatttgcactgctatagcaaaatacctgagactgggtaacttgcaaagaacagaaatgtattgctcccaattctgggggctgggaagctcaaagtcaaggcactggagactgggaaacttacaaaagaacagaaatttcttgttcccaattccggaggctgggaagcccaagatcaaggcaccagtaggttcagcatctggtgggggctcagtctctccttccaagatggtgtcttgtgcctgcgtcctcacatggtcgtggggagggaacagcaaaaagggggcttacctagtgctttccagccttttacaagggactcctctcatccccgagggctctgcccccatggtctcattgcctcctaaaggtctcaccccttaacactgctgcgttagggactaactttcaacatgaattttggcagggacacaacgttcaaaccgtagtacagcgtttcctaccctgagatccccagcacctagaacagagtgtggcccagaggaggctctcggtgccttctttccagcaagtgcctgaatctgtcagcctgctccagcctgccagggtaccgggaccttatcctgagggctgtggggagccccgatgggtttgaagccaggaggtggtgatgctgagaccggccggccagacgtctgggggaactaatcagcaggatgggaagcctggagcagcgagggggctgcagcccaagtccaggcccccccgaccccggggctgggcaaggagggtctaagggaaagcagaagatacaggctctagagagggagaaggcccggggagggctcaggcagggtcccgggttccttgttgtgtgtggaccgggtggaaggcaggacccttgtctgacatggggatcatgctggcagttgtctttcctcttgccttttgtggaaagaggggtgacgggcatggggatgagttcctgtggccgtggtcacattcaagtggctcgtgtgacacccaggtagacattcgctctgccctcttcctccctcccgccagcctgccactctccatcttcccgtccctccccaccctgccccgcagcacccagccctgccctgtgggcaggcagactccctggtaaaggtagaggaattgtataggtggcccctgcttggtttggctcccagaggcttccatctttttggcttggtccccctgattgccagcagaaggcactgcacagagccagcgtgcccagcagatgttggacacctgaagggataaacacggaagcactgtactgtgaggtggcacttgattggagatgctgcaatcaagattcacagaaggctctgggttgcttggtgaccagacgcctccgtagagcacctgctgtagtactggctcttgagaaacaagtcccaaggacagccagccttgctgagtgcctccaacgcaggccgggacgcagaggaggtctccgtgtgtgtttctccccacctggttgcctcccagctggctgacctcggacgtgtcccttacagcctccacaggttgagtgggagcattgtctgctcttgaaccaagaagggcttctttgctgtgcaccacaatgtccgagggcccaggctctgcacagccaacgggggcccccttgtgtcctccagggagagcctggggctcctccctaccgtcctacctcaggcagggccaaagctccccagtctgtggcttcgggccagctccccaccggccgcggcctgctctgactgctcagaagcttcttcctccaatgccctctttgattctgctcccgacggctctctgccctgcccagagcccacgacaggtccttgggctgccaggctagcacctgcctcctgccatatgaccctgccattccctggctggctgcccctacctggggtggggggagcagtacttcctcagcttctgtctggctgtgccccacccacacacacactgaaacacacacacacacacgcacgcacgcacgcacacgcacgcatgcacatgcacgtacaacctgccctgcccctagcctgtcctccgcagcctcacaggtgcaggtggctccttcccacctagcagggtttttctgagggacaacccgatgtggcacgccatgcttcccagactcagggtcctgctgggctgaataagtgtgagcttgttctgcgttggtccttgacacagctggttgcctgtggcacagtcttcaactcattgaagtcaagtccctctggaggagcgttggtggggcattggttgtggaggccggtggcagtgggctgggtggttccatggggctcagggtacaactgcattggtgatcagtcctctctgccttggtttgggattgaaatggccttcatagcaagctcagcccggtgcttgctcccagtgagcttgcctgcagctagatgccatcagcatcattcctcccacagctgccttccagctcccttccttcctgtgtgtgccactggctcttccaacccatggggcacactcactctcctcccaaggaggcagtgtcatctgggcatggctggccctttctgccaggagtccagggattcctgtcagaggcccctgctcctgctctttctgccctcgagcctgccggccctcctcactttgactttggagtttggatggtgactcagcagtcaaccagcattcaggggcagggccacggtttctgggagagaagcctgcagatggctgcaccctggttccagggactcgtgtccctgtcctctcctggaggactccggggtcctggcttcccaggtgctatgtgtgttgaacggtgtctcatatcacatatcagagtgaattttgggaccatggttgccaaggaaatatcaaggtttggctggagttggccccataagtgttctgtgctgtgtttctctgttgcctgcttccaaattgctccgtgaagttcaggccattcgtctgtgtccttttggttggttctgtggaagatagtttcctcgttggtctagttagccacaagaaaaagatgcccatggttttctcaaatcatgagtttgtgagcactgggcagtgatcaagttccctgggggatgccacaataaattttccctgtaggcaagactttaggagcaaaccaataggatagctcatagtcatagctcacagcaagcaagttgcctgcttgaaggatgggcctatgctgtgaaagtctgttggaactgagcatatcagggttctctaaatggatagaactaatgggatctatatacatatatatatacacatatacatatatatataaaaactatatatacatatacatatatataaactatatatatatacacatatacatatatatatatatatgggagtttattaagtgtttatactcccatatatatatatgggagtttataaccatatatatatatatgggagtttattaagtgtgtgtatatatatatatatataatatatgtgggagtttattaagtattaacttacacgatcacaagatcccacaataggctgtctgtaagcttgaggagcaaggagagcctgagtctcaaaactgaagaacttggagtccgatgtttaagggcaggaagcatccagcatgggagaaagatgcaggctgacaggctaggccagtgtctcttttcacatttttctgcctgcttatattctaacctcgatggcagctgattacattgtgcccacccagtttaagggtgagtccgcctttcccagcccactgactcaaatgttaatctcctttggcaacaccctcacagacacacccaggaacaatactttatattcttctatccaatcaagttgacagtattaaccatcacactgagctgggctgaactgtgcctccttgaggacataccacactttctggtagaaataaggcttttaagggtgtcagctcagaggagagaaggcagccagcagcacatggcctccggaagatcccaggccgtccctcttgtgacacaatgtgaccccatggcctggagttttggatggggggatgggaagaaggtgagtagtgctagctgacaagagctacctctaggggctttttgatgatcagtcaaaactctagtttcccaaggggaagtgtggctcaagactggaaagagaccctgtccaacagaaatctccttgtctcctggctctggtgtctctccaacctcagcagatgagagcactcagtagtccctggatttagccaacatctcgacctctgtagccacctctggtgtatacgaatgccccctccaagctatccctaacactgcttcctcgctgacttttctagttcacagacatgagcaggtcattcctatccttcacaaatatcagggcagtggtcattccctgaagacccaggtgccttgctgcacttctagggcagaagtccaaagttgttagcaaagtacttagcattacagacccttcgtggccctgtctgacctccctatggagctattgtcttctccttgcctctctgtccatcaccctgggacccagccacactaactttcactacagcctccaaatatctacagatcattcaaccccattcatcaaagagtgagtgccttggctgtggagagctcaccaggactgcaagttttgagagaagggaaacaaatgatgtagggccaaagatcagcccagatatcagcttagaagcacttacagtctatggcaaagcaaaggaagaatgcaaacagcatgtggcattctcactgagttgtgcaattgaatgccactggggtttctagaatttgcagtcactgtacagaagagaagggaaatgagcaaagaaagagctccagagcacctcacaaagttcccactgagtctttggctgcatactaagttctgctcagatagagacaccacaaggttgagcacagaacacctccaaagctgtgagctggacaattgtcaaagctcacacagtgttcagagatgttcaatttcccaccagccacagtggagagaccacattgaaatagctgggcattcagtacagagcctagaaatgccacacctcgggagcaagtctaaggtagaatgaaaacccacattaacaaagtttaaaaacaaggcttcaaaggcttatgctgctctgtaagtaaacaaactgcctgctggaacaactcaacacagaattaatggaaacaacaagaccaagatattttacatcctaacctaaaatatccagattttacacaaaaacttctagacatgggaaggagaaaaacgtgacccacaccaaggagaaaatgtttcaataggcccagaaatggcaaggacgatgggattagcagatgagaacttaaagacagttattagaagtaaatgtgttgttccagaattgaaagagaaacatgaaaatgatgaagaaatgattaaggaaggatctcaacagaaaaacaacaccgataatggagaatcaaatggaagctttagaagtgaaacatgtagaagagaggagccctgtgatagacccacaggtacaaagtcaaacagtttttgaccaacactctaaataaaatcaatgtcgaaaggaaagtcttttcaaatgcatcttgaccccacaccaaaaactaatttaggtactttttttttttgagacaggagctggctctgtcgcccaggctagagcacaggctcaatctcctgggctcaagagatcctcccacctcagcctcccaagtagctgggataataggcatgcaccaccacacccagctaacttttggggttgtttgtttgtttgttttttgaggctaaggctggtctcaaactcctgggttcaggcaatcctcccaccttggccttccaaagtgctgggattacaggtgtgagccactgcacccagccaatataggtatattctaagacctaaatgcaaaagctacaactacagaggttctagaagaaaacatagatcaatatgtttgcaaatgtgggccaatgaaagatatcttaggcaagacccaggcagtggtcattgtaaaaagaaacaaatgatgcaatggacttcattataattaaacccatcagcttatgaacagacaccattaagaatatgcataagaaagacacaactggtaaaaagtgttcccagcacacatatcaaagtacttgtatccagagtattttaacaacttgcacaactctaataaaaaatttaaaaagccaggtaaaaactaggcaagggacttgaacaggcacttcactaaggaagacagatagctaataagcacatgaaaaagtgctcgatattattagtcatcacagaaatgcaaactaatgcctcagtgagataccacagtgagtcacccaacagaatggttaaaagtttaaagctggcaatacaagattttttggagtaccctaagaaacgagcactgctcattagagtataaattgtcacaatagctttggaaatctgtgtgaagtttcttataaagttaaatataccactaccctgtggcccagccattccattcctaggtatttactcgggagaaaggaaaacaaaagtccacagagattcatacgaggatgtttctatcagctttaatcacacaataactgtaacacatatctatttttagattagggaccttaaaatagatactgcacttgatcgtagccaaaaggccaagaagccatgtgaaccttaaaaataggaatgtgccaggggtcagaaatggatgattagctagtaggcccagctctagggccatcagcctagaggcaacaaaagtctcactgctgtttggtggcaaagaaacttctacctctctctgccttctttccaaccctcttgatcccttaaagaaataaaaaaaaaatcaatcacccaacatttgcactcacacgaaaattcacacaccctctcataaactgtctcatacacactaacacacatactcacacactcacccattccacacattcacgcatatgcacacacaaactcataaacattaacacactctgaaacacacattcactcatgtgcacactcaacaacacaaagtcacccacacattcactgtcatacacacattcacacaccgtctcactctcacatattcacatacttttactaacacacatatacattaaacacataaacatacatttgaccactaacacacattcactcacacacaaaaactgatgcatactcacactcaaatacaaacacacattaacatattcacacaccatctcacacactcacatattcacacattcgctgacacatgacacacacaaactctcctacactcactctcacacaatcactagtacgcatactcacacatattcaccatctcacacacactcacagagatgggcctggttttgatgctccaggtgtggaagcccaatagtgatacaagggatcctggggccactggtccagcctgctgtccctcacccttccttaaatatgttattcatttctgagaagctcaaccagtgccctgaggacccaaccagccactgcctgggcctaccagtgtcctgtctactgggactatccagcctgctcagctgggtttctttgcctgggtccgtgggccgtgaaccctagctcatgaccaacatgcgcagatagggcattctagaatgccttgcagaccgagccccaagtatacaccagtgttaacaaagccactgtggccctcactccaccccaaccccatccccagccaacctcatccccagtttcccacagcagaggcgaggccggctggaacactgaatgaagtttattgaagagaaacacgtactgaaaacgttgaagagaagggaatcacaacacagagagaaactgcaaacggccaccacaggacacaggtcccacacaggtcccgggccccctcctcctgaggttcctggcaagacgcctcatctgctcctactcctgctgcagcccccgctgccaactccctccttcctgagggccccggggtctgcctcttgccaggaaggtagactctggcagtgtccactggctttagggagccccctcccaagcccatctgctgggacagggccctgccctatggcccgcacaggacagtcacaggacactggaaaacacagcagggaacaccctaccaggtcaaggaaactgagtcatgagtaacaacaggggtggaacaccaaagcacaaagctcctcgggagcctcaggcagggcagccccgctccgtcctgggtccagttcttcctcccacagtcacggtcaccatcgtggtcacagggtgagcgtccgccttgccctggtgcttccttcctgtcatctcctgggactgtgctgggggactccggggaggagctgctcagagaagaacacacacagctccacaagaacaagcagccactggcctagatctacacagggaaagcagaggtggtgctcatgacgcgggacagcagtgagcagagcctgggctcacaggaagctcacagcatgtgccttgggcccagaggcggccacctgggtgggtgcatagcacactactttgcacaggaacaacggctagcggtgggtgggcgtctgctggacgcgtgggtcactacaggggcctacacaggtgaggatgagcttcctggaacagggggcagcctgtcccgggaacggtgagttgggggacccctcttgggagacccaggcatctggcacccttgagagggcctctttccccctgtcatctcccagctcagggctgggggagtttgggacagacgtcttcaggtgcctccacccaggccatggctggctgcttaggggatgcctccaggctggattccccaaggtggcagggttgtggctggccttggaattggcattggcatctgttgagttgctttggccatggcagccccaggttctccttgcttgatctctccaggagtctggtggccctgtacagaaacaagcagaagaaacaaaaccctaccaagtcctcccttttcctcctcctcctttgcaacaaagacttcccttcacagccaccctggtccaagtcaactgtgagggcactggcctgccgggtacccagtacccctgctgggggtcttctcatcaatctttggtctccttgcctgcacaacctctggctggcactgggctcccggggccttagggtctcctgtcctcactggcacagggcctccagggtgctgccttcctggggctcccctagtgcagtgtagatgatcctgaagacgggatggaccctgtggcctcccctgcagggctttacctctgccccccagctcttcctcaccagccctggcacctgctggcaggggcaggccccaggtaggctcctccaggtcccatgtggcctgggggccagtgggcatgttcagctcaaagtccacagggtgggtatttaggggtggttggatgagcaggacagaacccccagccgtaccttcttcagcttctgcttctttggggtccccatctgaggcccaggcaccccatgtgctggatgcagtggctccctgctttcctctccagcacctcttcggggacctggacctgacccccactgagcctgttgccaggtggtcttggttgctgaagtcccttccagctggccaagggtgagaaggcttggccttggtctggctgccctgtccctctgccccactcaactcatctgctgtttgtctgggcttctctttcccctccttccaatatctcttttgtctccttggcctgtggtaggaaatgttgccctgttctcccgagcctacttggccttggacttgggatggctcttgtcccaagcccagttcccgtttcccgactcaactgcagcctgtttcttctgctttaccaagagcaggttggaggggttgatgcactgtaccctgatgtggccgtcttccccacagctatagcagaatgtgtggcgtttccgttttcttgagcctcgagagccagcccttgccacaccaccccttcggtgttggcctctgcccctccggcgccggtagccctgggaaggcctcacatcaaaactgttgccagaggcagggagaggtactgccccaaccccagtgatcctggcaggtggccttggggctacttccagcccctccagactctccctatctggacctaaagtggcctcccattcctcctcctcacgcaggagcttcaccagggccaggaaaccaggaggcttccttcgctgtttcatcagcttaagcttatctcggagtttgtcaggaagggtggccccacttaagactcgtttcaggcgagtctgattcacgtttctacgtgataccacattgttttctacagctctttggagcaggggttccaaacgtaacacaaagctagatactttctctcctgcctcctgataggctttacacaacttcacctgggcaattttatggctctccacaggtccgaacacctgctgcaaggcagccaggcactcctccacagttatggaagcattgctggcccggagcccactgaccacctggagagcagggccccgtaagcattccatcagcctccgcctcttttccccctcgggcacctgccacatctgtagcatctcagtggtgtgctcaagccaggcatcaaaggccagtgcacctgggatggatatggtgttcccagaaaacactcttagttctcggtacaacatttgttctagcagaggctgcactgctgcccccagagtctgggcccaggtccagaactctggtgatatagtcactcttggagccgaacaattggtgtccgacccgaggactcggttcatatctgacacggtccgcctctcctcctctaagaagcggttcagtctgttgagaaattccccatctgagttacggggttttacaatcacttcccagggccccccctttcctggtatttcccttgggagcaaagcatagtcgatatcttgtgccagctccagtagaatcgcctgggcgttctcctccctcctaaacatcctgccaatcaccctgtatctgcccaggtgcctgcaagcctcctggagtgtctcctcaaactcatcctcgccacagtcctcggggatccccaggatgagcatgcacctccgggtgttcaggtgttccccccgacaccagtcctgtaacaaggtcaacggcatgtcctcgaatctctgcggatactaatttggggggagtgatcagggcgtgaggcacatatctggatcaactcctagggtgatcgcagaaggcccaggtctccacagcctgtgaatgcgagcagggcgagagcgaggttaatgcccacctctccgcacgcccacatccacgcccacccccacccccacccccagccgccctcctccccgtgcggcgcctctgcagccaggcccggcccatgcccagccccccacccccaccccccgtggggtctctgcgggcctcagccccctccccgcgctgccccaggaccctggacccctgccctgcaggctgcttcagttctgatagggcggacaggcgaggggcggcggagtctcccggggcccagcgtctccctccccaggtgggtctgttaccttctcccagggcaaggtcccttctggtcggggtccccagagggctctccgggggctatgcgcggcggcggcggcggcggcggacgggggtcgggcacccctggctcccagcgcggacgttcgctcagactgtggctctccctcgctcgcgcagcacgtgggccagtgcgccggcgcctgctcgccgcggctctctgcagtgcggacacggggcgggggcgcggcggcggtgcagcgcggacccctccgcgtcgtccgggagaccgcagggccattggcgcggacgggtcacgaggtcgggctctcgccgccgcccctgggggccccaggtccccgggtgacgtcacctgctcctctcccctagcccccccgccacgggggcccccgggcccccgggcacacaagcgcccgcccacccccatccccactgcggtggccaaaggtctgtggcggccagtccccgtgcctttggctctcaccacagcggttcctggtcccggctcctgcccctcccgcacgtgccacggaggtgccagcggggcgaggggtctgcaccccggcgtgcccaccagagggccagggagtggtctgaggtgcgccaggcagctctgcattatggccagggtcagggagccgggttctggggcctgttcacctgctcttgtcctccccctccccgtccaggactggtcctctggctggcgaggccaggggcacctggtgcgggtgccattccgtgcaggagatgccccaggcactcatgcaggtcacgcacaccaccccaaggagggtcagccatctccccgctgtccatcccgctgctgggacctgaggccctccggccaaagcgcttcgctgcccaggtgccagtggacaggtttaccgggacctttccggttttgtgcgctgcaaatctagtgacttgggaaaccacttccaggacttggagcccaatcccttgggcctgcccttccttggcagccgtgcgccgtgggttctattgtatccgtttgatcccagggcagcagccaaatgaagaagggagtgactgtccctcaggcagtgggcccaggtgttctgtgggtcctgcctgctctgccagccgcatgctcaactcctattcacacagcttcagctcctctccaaacacaacgaaaaggggcttgtggttgattttcaggccaggttcacccatccagccaagtctgggaggccaccttgcagtgagtggggcacaaaactgtccactgacttcctgccccaccctgagttctgctcgtcagcctggcacttgtcagggaccaagaagaaatggccccaagggctttttcctggtcagacagaattcctgaaacatctttacaggagttatttcatttgctcctcaccagaactctgaagcaggtattaacattatcctgatttgactcatgaggctcagagagattaagagacattttcaaggtcacacaccgtattgaaggtagaattgagactggattctaaattagtgcccatcagtctttgggtagaattgggactatttctcccctggttgcttcatgcctattagaatttatttctctcatttttgtccattcacagtcccttgctttgtcactccaagggctcaaccagcttcaaactgaaccttcatctgcccaacttgcaggggtggaaacagaggttcagagaagggacactactggcccaaggtcacacagtgagtaaatgacaaagcttgagatgtcaaggggagatgccaagtattcatgccaaggcagaggggcgtgtctggaatgtctccggaaagaagcctgtgaagttcccagacagacgcagtgatctgtggatgttctgggcattgggaaaaaaggatttggaaacactggtatcaagacaatagatgtgaatatgtccaatttgaaaagttttagaactcctttatattggagttaacctttgcccttgaaaccagtggaaatgtcttaattacttttgcttccccatctccttgcatggtagataacacagcagcaccaaagttggggaactgatggataaacattattacttgtaaagtgaaaaacataatacagcatgaaggaagcaacctccaccggggtggccttgccctggcttagaccagtagtgactatcggggtcacaaaaggggcagattcatgggccccacctctgcaatctgatctgctgagtctgaaacaggcctgggaattttttaaagagtttctggtaattaaatactttataaaatacattctgcaatatttaacatacaaaacgtacttaaaaagtacatccagtactcctgaatgtagtaactggatgaagacataaaacactgccagtgagggtaagcgcctgcagattccttccctgttgtctcccactcttgtcctccatgtgcatttcttcgtgctttttctgcaaatgactatatccctaaaaaattgtctttgtctcttttacacttggcagaaatgatatcatactattcatagtcatcactgtattaactaattattgtttgtgagaatcaccattttgatataagcaaattttattcctcaattttcacttctgtatagtattccattgtgtgtgtgtgtaccaaaatttatcaattttcccattgacagatatttaagttgtttcccatttttactatcagaaacaatgctgctttaaatattcttggagagttcctctaagttatgtacctagccatggcattgctgaatcaaagactatctttagtattcagagacattgccaaattgtcttctgggttgctgtacaaatttatgtttccatcaagctccatatcatcactaacatttcatattgtgtgacttaaatgttgttaatcctgaggaatgtcaattgttattatgcttttatgtagaatttctatgattatgaattagatttaataccttggttgggggggcattttttattcctcttgattgaaattcctatttttgtctcaattctcaactggggtgcttctcttttttaattctttcataggagttatttatttactttggatatttcttcccattaagttactattcctgcacaaccagctacccaaaacatactggcttaaaacaaccattttattctgctcacaattttgtaagtgagaaattgagagaaggtttagctgggcagttcactcatgggatctctcatgtggttgcattgagatatgagttgagaatcaagtctaaagactcaacagggctgggcacccaagatggttcattcatatggctggcattgagtcacacttttggtacttgcagcccaaagcacgctaatttttatagaagctcagataacaatagctcctctgaatcatcattattggaccaattaagttttttatttggactttaagaaatttctctgggaaaatacacaaatggacagaaattacacctcttaatttaagactgttatgggttgaattatgtctccccatacctcaattcatatggtgaagtcctaatccttagcacctcagaatgtgaccttatttgaaaatagggtcattgtagatgtacttagttaacatgaaatcaagctggagtggtgtgggcccctaatccaatgtgacaagtgtccttatagcaaggaaatttgaacacagaaacatgaagatgctcagggagaacaccatgtgaagatgaaggcagagattggggtgatgcttccacaaaccagtgaatgccaaagattggcagtaaagccccagaagctaggagaaaggtctctgagcagattctcccccaccactctcagaaggaaccaacactgacaatactttgatggtcttctggactccagaaatgtgagacattccatttctattgctttagccacctagtgtggtactttggtacagtcactctagaaaactaataaaaagattaaactgcaaatcttcgaatggtaaaaatactgaaaggtttctgaaatggaatctggactagatggcataactatttaataatgaggatacatgagagccagaggagagcaaaggaattacttataagataaaaaaaataaaaaaataaaaaaaagaatctggaagtaaagagacaagaacgactccccggagtggccaaagcccgtgcaccactgcatccctcccccagagcctatgtcccgccactatcaccaccatccccaagagaaaggctgaaggggatgctaaaggagataaatccaacatgaaggacaaaccacagaaaagatccaagaggttgtctgctaaacctgcttctccaaagccagagtctaagcctaaagaggcccctgcaaaaaagtgagtgaaggtacccatagggaaaagggtaaatgctaatgctggcagggaggggaataaccctgcagaaaatggagatgacaaaacagaccaggcacagaaagctgaaggtcctggagatgccacgtgaagtgtctgcatttttgataactgtacttctggtgactgaagagtttgaaatactgttttttatcgagttttataaaaattcataattttgttttactttttttaagctatgctgttagcacgcagagcacttcattgttgtttggggggaaaggggcataggtcactaatagaatgtctatgaagctggattgatgtggggaaaacacatttcccttctaggtttgagagacttcctattggttcccaagaggagagattccctgactttgacacacatggccaccttggcacaaaagccttggtatggaaaaacaaattgtttttatgtcctcttctccctttccacctttcatcatagacttaactcactcaaacccagacacctgttgggacctgaacccaaataattggttaccagtgtgtcaggcaatctggacttgcctgtgatgccactgagatggtgcccctcaaaagagcagcggttctgtttctagattgtggatcatcagataaattctgccattttcatttcacttcctgaaagtcagggtcaactcatgaaaggttgttaaaacaacatgctaaatgagaaatgtcaaccttcactctaaactttccctgttcagagcatcagatgaagtcttcattgggttttacagtggctttctgatttttggtagtccattgaagtagggaatttgaaatgttttatactgtgaatgactgcccatgtcctgcctgaaataccatgattgtttctggaaagtatctttaataaagctagatacagtttggcttggggaaaaaaagaatctttcttttacaggttagatttaagtaacagttggtcactgtctgttcccttttcatttgcctcattgtgctctaaataagaacttttacattgttcctgaccaacagaaggccagggcccccacaagagcaggccgtccttgattgtaggatgatgtaaagttacaattaccaattctttttaatcataaaattcccacacaaacagatagtgattatgggtcaaagttttatttaactaatcagtgagggaggagcagaatgaagagctggttcgaaaagatttgaaggacttatagttttgggggaaagaaatgatgaggtaaattgctaagttaaattcaaaactgatttactccttgagacaataaggccatggcacttatttcccattcaggaaaaaaaaaaatcacacctttgttactttacagaattgtaaaacatttgggctaaaatgaattttagtcaatcaaagttaaatttctgggaacaatcaagtgagtccagaattagaaaattatctagcccaatattaaaaagtcagagtcatcattttgcagcattttaaatttaaaaactttagagctgttttaggttaccagcaacactgaatagaaggtagagagttcccatgtacctcctctacactgctaacacacaacccctgccactactgacatcctgcaccagagtggtacatttgttacaactgatgaaaatacatggacaaagcattgttgctcacagtccatagtttaattaggattctgtattagtctgttctcacacttctatgaagaaatacccgagactgggtaatttataaagaaaagaggcttaattgactcacagtttcgtatggctagggaggacttggtggaaggggaagcaaacacatccttcttcacacaatggcagaagagagaatgagagccaagtgaagggggaagccccttacaaaaccatcagatctcatgagaacttactatcacaagaacagtatgcgggaaattgcccccatgattcaatcatctccacctagtcccacccttgacacgtggggattattacaatttaaggtgaaatttaagtgaagacacagagccaaaccatattattccacccctagtacctcccaaatgtcatgtcctcacatttcaaaatacaatcatgcccttccaacagtcccccaaagtcttaattcattccagcattaacccaaaagtccaagttcaaagtctcatctgagacaaggcaagtctctttcgcctatgagcctataaaatcaaaagcaatttagttacttcctagatacaatggggatataggcattaggaaaacacacctgctcaaaatgggagaaattggccaaagcaaagggtctacaggccccacacaagtccagaaatctaatagagcagtcattaaaccttaaagttccaaaatgatctcctttgcctccatgtctcacatctaggtcacactgatgcaagaggtgggctcacatggccttgggcagctctgcccctgcagctttgcagggtacagcccccttcccagctgctttcacaggccggtgttgagtatctgtggcttttcctggtgccatggtgaaagctttcattggatctaccattctggggtctggaggatggtagccctcttctcacagctccactaggcagtgccccagtgggaactctgtgttggggctcccacccaaccccacatttcccttctgcactacctgagcagaggttctccatgacggccccacccctgcagaaaacttcttcctggacatccaggagtttccatacatcttctgaaatctaggtgaagtttcccaaacctcaattcttgactctctgcacccgcaggtgcaatagcatgtgtaagccttcaagccttggggcttgcaccctctgaagcaatggcctgagctctacattgtccccttttagccatggctgtgatgcagggcaccaaatcccgagactgcacaaaacagcaatggttccctgggcctggcccacaaaaccattttttcctcctaggcctctgggcctgtgatgggagaggctgccatgaagacctctgacatgccctggagacattgaggaggagcacataacctgtaatattccagtgctggtaactggagcctgtaatagaatggtgctttgaatggaggtactattgaaaattataaacagtcacaaggagaaataagtggaagataagagtgagcaatggaacttgcttgcttctaagtaggaagaaagtgggcaatagtttcatggaagagaaacatggcagaagaggacatggctttatttattagatatttgggccctcttgaaaatcacaaactagaaatgttgtataatattcacgttccattgcatttcaatttgtagggttacctttttatacggtaagctttttgacattggagcccccttggtgtttgtcctgggggaaggtgagcttttcctcatttctggctgacacatttacttgacttggccagtcggggtcaccataatgccactgtagactacatgataacaggagggtctccatgaatgaggttgaatttgacacttccggggaagacacaggagatacagacatggtgtaggcttcagagtgttgtctagcttgcctttaggatggcaaagaggattggtctgtggaggcaaaatgtcagatacttcccctttgaaatcaataacgttaggcctggattatgaccagctgggttatcttcatattggccatcagtttatataggtaatcgctatattggaaaccccagtcaactcatggagacatgaggttctgtccatgcctacacagtattgtcatgagtcccagccttatgcaatgatcttatgtatgtgtgcatgtgggcagggtgggcagggtggtggcgatgtgttagtagctggtacctgactttttgtttttggttctctggtgtagtactcttggaaatttcagaaataccaggtttcctatcagtcactaaggaaggccttccatttcacactttatagatgtcaggtgtcaaagagtgcaaattcatggaccagtatagttttctcaccaaatgtcctttgggagcttagcatctccattctaaaccttcctgtctttcacttttttttttctgagacatggttttgctgtgttgcccaggctggagtacagtggtgtgatcatggctcactgtagccttgtcctcctgagctcaggcaatcctcccacctcagcctcctgagtagctaggactacaggtgtgtgccaccatggccggctaatttttttgtattttttatagagatggggtttcaccatgttgcccaggctcgtctcaaattcctgggctcaagcaatctaactgccttggcctcccaaagtgctgggattacaggcatgagccaccatgcctgaccctgtctttcacgtctaatatcaacagtggttcttagcaactaagggggctggagaaagaaacacacccagggagattggtcatcccagcatacaacctcttgattgccccagcacaattttcagtatacaaggtttccttgctcctataaaggaatgattcacaaaatctaaactccatacttcagtgctagcttaaaattaccaatttatgcctagtgttccattattggaatgctaagcatgtgggagttatttatatcctactgctcaaggtcatcaccaaggtctgattgcaaaaattcaaaaaattgcaacctcaggcataaatgggttaaatcaatatcccttaaagaaaatgaaaatatcttttgtaaccaatagtccgtaacaggaatctaaagcatccttcccctaataatttacaataattatatctaaaacctcagtcccagtgacatgagggtggagctaagggatgattggaagcataaggggcattttcctgggtgactgaatggtggttcaggaattcaccagggtgtgggtatgggtggcctttgccaaaactacaatatttcctgaaatgcagggtttggaaatgtgaggaatctagttgacctccaaaagactatactttcagcattttttatagtaattttgcaatttatgtgccaggattctatggccacatatacttgtgtccgtgaagccactagggaaccaggcagagagcttctggtccctgggtggaatagttaaagagctgaaatattaaatgcaacagcaccattagctgccaatcctctgcagcggcagcttcagtgccttatatctgcatgggatccaatgtcaaatcacggagtctcttctaggtagacagcaagccaatgctcagatcagagagccttttgggagcagtatctttgttaaaacctaacaacaaactagggttagatctacttatgtaaacctgtaaaatactagaagctggtttcaaaattaagtaatgggaattcttgaaattcttaaactgcattgcccaaaataagaaaaagttcaatagtagagctgatgacagttgactaaatcacagatctgaaagttaaagatcaaggaactctcccagaaaatgcaaaaagacaaagaagtggaaacgaacataaggaaaagagcactaacagaatttcccaaaagagattacagaggaaaaaggaagccactttttccccttcccatgagggggccccggggacagacccttttccccttcccatgagggggtcccggggacagcacccttcctccacacattcccagccacacactgctttagtggaccacacatgctcgtttctacttctttgtcttccttctgtgttctccagcaggtaaaaacttattgcagaacgttgtaacttggctgaacccccttaaactctgattaggacatcaggatgggctgtgatctgaccatagtcggactgtatatgtaccatgcacacatactcctggcataaatctggggagccctatctgtttcttagcattctctggggagagcagttcctgaaccatccaggcttgggggctgcaaaaggaacagcagcatgcccaacacctctgaaccctcctccccatacccccccttcaccaccaactgcaagtctaggtgctcagctatcttgaggaccatccactgctggtgggaaatcctagcatgggcacatgccttggggtctaggcccaggccattgtgagctctgacaggttaaacctcccctctgctgccacctgtgagatcaccaccgcacctgagatgccaccttggtctgcttttgaaggtgtttgaaacactaaagagtgtctcatatgataggcaggtaattttcattaaatgtttggaaatgtttggctgataaggccaatatttgaaggtctgtgggaagttgatgtgggcaaatctccaaactggggctcagcctaggagggttcttgtcttcatgcatgaacaaattcaaaagaaagccgacagagtaaagtgaaagcaaaataagtttatcagagcaacagagtacaggaaaatggttgctccatagagcagggctgccccataagcacagtagccctcgtggattgctggctagctatatttatagctactccttaattatattctaaataaggcataagtgattcatggattttctagaaaaggggtggaatcaagagttcctccccttttaaaccatataaggtaacttccaggcactgtcatggcatttgtaaactgccatggcactggtgggagtgtcttttagcatgcaaatgtatgacaattagcctgtaatgagcagtgggggcaaccagaggtccctttcatccccatcttggttttagctgttatgactggtttctttactataacatattttgaccagatcttgtttttatcagtggggtcatgaccagtgctcagaaaacaagtcctgctgatctcctacctcaaaattactttgttaaatgcatagaatatgcattcagatgaatcttggccatttgtcttctattattattgttattaattggctgctttcaaatttatgagattaatgataaacaaaaattaaacaaagtacaaatagcaactgatacttctctgcctgccttctccccttcccctgagccatacatatagccccaggcagcctccagggtgatctaggatgtcttggtccctagccagtctctgcctccatttatccagcatcttgccatacccagccaccccacctcccctgaatttctcttgcactactgtgaaggcggatgcactccaactctaagattcagttagagcgccattaattaagagtttcttaatattgttcctgggatcatggacctctggctgagcattcccctagagtgctccctaaaacgtgagggccatgtaaactgtattctctgttgccccccttttgcctagctcacaaaccactcacgggggagtaaacattgatccagacactcagcttcctcctcatgttctctttccattcctcagtaacaggaagactccccaacgtcaaaatctccatgcttccatccacaggctctgggaggaaggagctgggggaactatgtgtatgtggttaacacctgaagagttcgattaggtcctgtatgagtttcctgtgtgtaataatttgttaaattattggcttaaaacaacagaattttattctctcacagttctggaggttggaagtctaagatcagtatcactgggctgaaacaagatgtcagcagggccccactttctctggaggctccaggggaggatccattcctagctctttcaatatctggtggctgcctggattccttggtcttaaggacagcattttcaaacctctctctcttccctcatcatatcacctcctcctgtatgtgggtgtgtgtgcagacaatctgcctttacctccttataaggacaagtgtgatcggatttagagcccaccaagataatccaggataatctccccacctcaagatctttagcttaatcacattgtaaagacctttttcccaaataaggtaatatatacagattccaggaatttggacctgctatccttgggggccattattcaacctaccacaggtcccaatttgtgccctggctctggtccaacccacgatgcccacccccacccgtagggtagcagtggatcctaccagcttacagagtcctctccacagcctcccttcccctgatcgcttcctttggaaagttcctgcagatacttatctaagaaactctcacaataaaacacagtcttggctttctggttgaaaaattctttttgacccttatatgtctctccaacctaagaactaatagttcctggctccagcctggatgaaaaggttggattttacagctgtctgttgctaacagccctccataggaataggctcagatttttcacatgcctcatagtggcacacttgaaagacaaacaatcttctctcttattaatatagttcatgtcacatgatataagttcactgttatagcatgaaattcttgatacaagttatacaggggtgagaacagagaggaaaagagaacctgaaggaaatacagagaccaccctgccatcttcacctctttatgtaatattgtgtctaattagatagatgtacaccaaacttatcaaagtattcactggccaggcatggtggctcatgccggtaatctcagcaatttgggaggcttagataggaggagggcttgagcccaggagttcaagaccagcctgggcaaaatggaaagatcccaactcttcaagaaataaaaaattagctgggtgtggtggcatgtgcctgtgcccccagctacttgggagattgaagtgggaggatcacttgagcctgggagttcgaggctgcagtaagctgtgaccacaccactgcactccagcctgggcaacagagtgagaccctgtctcaaaaaaataatatattttttaaaaccacttactgctgagaaggacagtgaggtttaggaagtgatcaaagagaactttttatttttacttgatttaattttgtaaacattgaatgaatgttttgtttgtccaactgaaaacacaagataaatacgtatgcactaacacagaatgatttctatgagttaccatttaagacaaaaaaacaagacaccagacagcacttacaggataatctcacttaagtaaaataaaaccaaattatatatgcatatatttacatgtatgagtgttaaaggaataggcagagttctggaaggatgctgactgaggaactcacagtgttcatctctggggaaggaaagggatggagtggaaatgtgactttcagtatttcttctatatatctccctgttgtttgaattctttacaatgaaaatgtagtcaggaagtatgatggctggttttacgtgtcaacatggctaggctatagttcccagttgcttggtcaaactatctagatgcagctgtgatgctattttttaaagatattattaacatttaaatcaacagactttgggtaaagcagattgccctcttccacaatgtggatgggtctcatccagtcagttgaaggccttaagagaaaagaccgaggtcccttgaatagaaaggaattctgtgttcagacagcctttggactcaagctgcaacattaactcttccctgggtctccagcctgctgccctactctacagatttcagacttgccagcccccaactcacaatcatgtgagccagttccttaatgtctctctctctctctctctgtctctctctgcctcaacaggagatacatctatctctcctattgattatgtttctctggacagccctaactgataccaagatgagaacatagaaaaggagtcatttttccattcaggactctgcttcaaagacatgctcttgagctgaagagacctggcttgaaatgctgcctttagtgaccctatctgtgttcttgaccgattaagttgaacttgatgaatgtctgcttacttctctgtattaacgagaggagtcacaggaaagaccatttgcattactgatgcacattgagcatgaccacagttcagcaagtaccatttactgttattaataatatttatttttcattttatgctaagaaaactatcgaaaacaatttaagggttttgagcagtgaagtgatataatcttatctgttttttaaaaaagaattcttactgctatatggggaatgcctaagtgggaggcaagagtggatgcaaggagagcaatgaaggaggtcgttgcactaacacagaggagtgatttggactaggatggtggtggaagagataaagagaagtggaagtgtttgagaacatttaaggagtaacaattttattgatttgacttctgcttaggggtatgaaagagtagcttttggcagacaaactctcctatagagaacaacaagaaaagcccgatgaaacatgacaaaaggatcagtttaaaggcactggagacctattaaaatgatgaatacttgaggggccaacatgcaggaaagaagagaaccatgagagggtgaggtggcgctacagacacttccaggtgcagggaaggaggctgagaattgaggctttacctagatggccacggctgggggtcaaacacccagcagagatttccacagtctcacagggctggagagacaaacttcgtggcctaaggagccaagattccaatgagaagtgagagatggaagactgtgtctgtcacactgttggcttgccacacaagaccaatattgaattatgaagctgtatgtagtaagaagctaaggagccaagaagaaagccttttgaaaataggacaagcaaaataaataaaagcattcatatcagaaaggaagaagtacaactgtctttatttgcaggtaacattttctgtgtaggaaatctgatagaatctacccaaaagatctattagaactaataagggagtttagagtttagcaaggttgtaggatacagggaagcagaggttacaaaggggaattaggaactttctgggaatgatgaatacactcgctaatcttgactgtggtgatgggttcacaggtgtatgcctataccaacatttatcaaatgttacactttaaatatatgtgtgtgaattgtgtctgagtaaagctcttcaaacaaaaagaaactaggagggaaagaagagggctgataggttggaagaaacagaggagtcaacatctgaaggccccaaagaggttgaaaaaggatcacagtagggagtctgtgtcagaaagtgacatacttgagtcattgattctcaagatgggacaattttaggagatgacaaagcctggggtgtgactgactgggggcaggtagcttaggtagaggaagcttcaaggcctgctgcatattctgtctctgttgcctgagcatggttccacccccacctctactctttgcctggctaaatcctacttatcctccatgtcccagcattcatgtcccttcatcaaggatacttcctctggcacccgcaccctcttctgaggtcactctttaagacattcttatagcactcttgtactacttgccttccttagcacttaacccagtgatcacatatgcatttgtgcaattctttcaacacatcaaagctctgtgacagcaggaaccctggaccattgtgtccctagcatctgccacaaggcacagcagggcatagttgctgagtattgaatgtataacaggatggcaaatgaaatgttgcctattttcacagaactttagcccaaatctgaggacaagaggtgctaagtccctgtacgatctacattctcaatggaaacatcacacattgtttgttatataaatgaaccaaagatggcctctgtgtattggcccctatgttttttatttcttcactgaaggctgagacctgttagctgaaaagctcactggtgcccaactcatatatttacacgtctgattattatgattattatttgagacgaagtctcactctgtcgcccaagctggagtgcagtggcacggtctcggctcacttcaacctccgcctcctgggctcaagcgattctactgcctcattctcccaagttgctgggattacaggcacacaccaccacgcccagctaattttttgtattttagtagagacagggtttcaccacattgccctgggtggtcttgaactcccgagctcaggcaatctgcccacctcggcctcccagaatgctgggattacaggcatgagccaccgcacccagcctgattatttttaaaacatcccaaataagcagttttttagccatttaaagcctgcttgctttgcatatgcagagactctccaacgtggtaccgattgacctcacccagacacataagctccctctttgttcctcctctgccctgtgagtccctttgccttccttcccttccaggtggtggcctcttagcccatccataaacctctggatagtcttgtgctgtgaggactttccctcttatgcaaccctgtccaagtgccaccgaataaagcttgttgtgttactgccccttgcagtcatatctttttccttgatcagccctcaaattccttcaacaaactccctgagtttactaaatgatggcaaagcccattcagcaaacaccattccatcgaggctattgaagagattaaacatgtcagaggttatttttaaaggaaatttttaggagcaaagagtgctttggcttttctcctaccctccccaggagggaggataaggaggcgctgtctctaaaaccaaatcaaatgcatcagttcaggtcctccaggaagtcaagatggagttagaagtgcaaaaaaattatcacagaagataaaggggagaggacacagaaagaggcaggaagaaccttcagaccacagggcgggtctaacacaagtggaaagagagggagaaggaaggattggaaggaagagtctcagacagtggtgcagctttcaaaaagtcttggccagcccaacggggagctctgatgcaaagatggcccatagaggagtcccacactgagcaaaaatgaccctagtaccctgctgtgctaagcctctgatagggagctgcctggaactagcatggtctcacctcaaatgctgccttggaccctgaagacattccacctgaatgccgtcaactaattgcactcctcataacaggccctctcttaaagtgacatccaagcagtgcacttccatagctgccacaggccatcctttgtgccacacagatccactactccatagctgctcgggaagcagttcctccttggctcctgtgggccactctttctgaaggtaaacttagaagttggcggtcgggtgcggtggctcacgcctgtaatcccagcactttgggaggccgaggtgggcagatcacgaggtcaggagatcaagaccatcctggctaacacggtgaaatcccgtccctactaaaaatacaaaaaaaaaaaaaaaaaaaaaaatttagccaggcatggtggcaggcctgtagtcccagctactcgggaggctgaggcaggagaatggtgtgaacctgagaggcagagcttgcagtgagcagagatcgcgccactgcactccagcctgggtgacagagcgagactctgtctcaaaaaaaaaaaaaaaaaaaaaagaaaaagaagaagagagaagttggcgggacaaagtacaagccccatcagtgcagttggtcctgcaactgcaacaggtatttatgattaccctcttccactatccattctagatttccctcaccctcaactataacctctgcagttttggcagcttccttcatccctgagtggtctgagtccctcgtatccatacccttcttaggccactcacactgtacttgatcacttacagccaatgaggcaaaagagtaccaaaagtcactagaaaagatcatctgagtcccgagcatattcctctctgcctctattatataacagcagtcttacctcttccttgataattctctattactcccaccaccatgatgattcttcctgcttgctggtgtctggaatcaaggaaccccaaaatgccaggcagcagtggtggctataagtacaactggaacccaggctgtatgtcctgataagagtgcaaagaaccagaacctctaccctgcagagcctagatttaaggagatgggaagcacaatgttggcccctgagtaggtcactgggaaagatggaaagtgaggccactttggcctccaccctatggcttccagacccatgtattcttcctactggggacacagtgccacatggacatctctgacacagtgcatatactgcatcctggaggatggcgcctcatccttgtagggtattgcctctaagcctgtgctccagctacacctccagaaggccattccaacactctatcaagctagtagcttctgggtggcacagtgtgacaccagactatcccatgctcatgggctcatgcacatacctccttcactctgaagtgtgtcccttggtaggataccttcttgtgtgggattccaggtctgcaggtcatgcactctgaaagcccctggatagtgatgttagctgaagttctgccaggaggaaaggaaaacccatactcagaataggtttctgtccttgtaagaaagaatggatgtctcttctaagagataatggacccaacatggagaaatggtgccatattggggtctcagcattggtctctttcactggaagactggaccttcagagctagtagcagcaataaaggccttgttaagtaggattctatgcttctgggcccgtgagcagtctccatctctcacactgtggcccatctgtttatgtgcccattgtgtcagttctggactggctgatggtgaagggtggctaatatccaacttgctgagtcattttgtgcacttgacagttcagctcctcttctactgttgatgctttctggtgggcacttgtatgtgacgtaagcttttccttcatgctcactcccatgtttatccatatgcctctaccccagacctccttgtctccagttttccagtcctttcctttttagacctttggctagtccattggccactgctcagaaatctgtgcatattcccaccctgggccacttcttccacacaaagtggatgataaggtgcacaccttaaagctccacccatcaggaagatcttccctccccactgtctttcagggacgtccctaggtgggtgtggctggaatatagctgctgtccatttcagagactgagccaaaccattcataagcaatattcaggccttttcctcctccttcatctagccacatgagatcgcacagccataggtgtgagctaagggaggggcactggtgtaactgtgatgggtcacacaggtatcttggctgctacttccatagctcactcacacttctgttcctgactagatgaactatttccatcgtgcaatggattgctggagggtcatctgacttttcactttgtggtctgacagacccagcttataaggagaaattccagcttataagtgacacacagtcacttggtgtcccatggtcaagcgttgtctctgcaagggcccagaagcacaccagaagctgttttctaaaaaggtgtatgattctctgatgcgggtggcatggccctgctccagaaccctaggggcctgtgtggcgatcctcccatggggactggccttaaaccctaccctgcctccattcttaccactgacacctctgacactgcagggtctgtcagatgtgacggttcaagagttgcactgcagcctggacctgctgcagatccctttcctgctcccagcctctctcaaatctcccagccttctgtgtcaaccagtgtgtgaaccatagaagttatcttatgggtggaatgttttctccccaaaacctaaagaggtccaccaggtgcactactttctttgtggtggaggattcaagaggcagtaatttgtcttttcctttggaggggacatcctggcacgcctccgaacactggacccctaaaaatttcactgatgtagcagatctctgaatccgcatagggcttattgcccaccctctggagtgcacgtgtctcaccaaggcctcccagtgtgtaggctgcctcttacttgtcctgtccaatcagaatgatgatgtcagtgtaacagatccacgtgccattctatgcactgtctagatgatccacatctctttgaactatattatgccacaggataggtataacacagggcagaagcgttaacatggtcctgagacaaattgtaaataaagatttttgtttgtccacgtgatcgtgaaatgcttctgtgtcagtccattttccattgcttataatcgaacacttgaaactgggtaattataaagaaaaaaacaggtcttacagttatggaggctgagaagtccaaggtaaaggggcagcatctggtgagggccttcttgatggtggggactctctgaagagtcctgaggtgccacaacacatcacatggtgagatggctgcgtgtgctccggtctctctgtctctcttcttcttcctataaagccaccagtatcactcccatgataacccattaatccattaacccattaatcaatgattgcactaatctactcatgagggccttgccaatgagtaagggagtaagtaaggtaagggatttagtggcccaataccagaaaggagcagtgtgtttttagaaggcattctcccaaatcctgcctggctgagaaggggaagacttggcattttggggacaattcaaaagtagaatgaatactttttgttagttttaaaacaagtgaaaaaaaaaaaaaccaatgactggggaacttcatctgcttcccttacacttgaaaagtgtaaggcttaaagccacacctctcaatactgtcacactggggattaaatttcaacatagtgaggcagaaatttaaaaataaatatgcattcattcactccaaaaaaaaaaagtaacaggcaaggcaagggttaagaagaaaaaaaggggttttcctctgcctagcaagctaacttcaaagacagttataagataacgctgtttaaggagccaaggccaaaggaatgggctccagacacccctcccctccaaaacaaggttaaaggaaaaaaaagagagaaacacaaattcctttactgttactcctttccctggcttcttaagcatacctatgttttacaaatatctgtatttagccagttcttatttttctttcaacgcaactacaaggccactggctatgcaaggccacaagttatgctatgctataaattatataacctatcatataattagctacttttattttacttttgtaaatccgcttataaaaaccctgctctgtctttatttaatgctcagcttcttgaatacaaatccactaagctggtgtgtagctaaaataaacaatcctcctgttctccatattggtctctccagtcctcaatttcccacaacaataggtttaggaggggacaaacattcaaaccacagcagcttcttatcctctttccttgaccagctgaaatggaaaggaatgccttcatcaaaccaatggccacatactatgcacctaaggccttataaatctatttgagcaatgatactgtgtctggtacacagcatctgcaactgggattactacttgataaagcatgaggtagtgtacactcattctccagaattcatccaatttctacaggggacagaactggcggataaaatggagatatgatggggaccaccatacctgttaatacatcctagaggtctttaaagtggctctaacctccattatgcctcctgcaaaattgtttttaaggtcaccttcagaggcagatagatccccactcaaaaatcggctaggatgttaagactgatgacaccacatacacaccaagaggacaagaaaagtttcactacttatgtaattgagggttttcaggagaggggagcagtcatctccagcaattccaaaatggcttctggaagcaaaggaaggagagtggcctaggttttcactgaggttagaagcggggggccaagatgagaattcccacatggagacaggaaattgcatggtttgaatttccttcatgcagcaaagaagggagcatgcaggcttttttgccaacttgctcagaggtaagttacaatgggaaaaggaaaggtcagtttctagggagaataaagactgaggcaggtgcttctccaagcactgctgctgctctgggaaagggaggatcttagttacttgaaagttaaactttaaagtggcccgtgctctgcctggccttcagtcaggaaggggttatatgctagaaggaatataaagtacggccaaaagacaaaaccactgtgaaaagagatgacattgggctttctcaggtgcttggaacccatgccagcacagaaattgcttgacttcgtataagcagaccaggaagatactgtggacatagaccagactgggcaacagagcaagactgtgtcaaaaaaaaaaaaaaatgacaacgggaaagtcacgactgtgctgtcactccctgtgtaataattgagctttcgttgaatgatactgagggcctgtccaggcaggagtaagaatgttagatttccaaatatactgtttggggtgccatcacaagcatcaaggaggcaggagatggtataccatactggacagtttaggagacattttgagtatcaaaatgcatcagccccccatccttcacctttggactcatgccagagcaacagagccagcaggcttgctaactgttgacagaaggagcacatcacaaactggaagcggtagagtgtaatgaaagcagcacaggtcccagaattaagaagtctggttctgcaattttgtaaccagagcaattcccaccaatctcttgtccttggtttctacctttaaacaaagagagacttcatgatctctggggctagggaaagtaaggctccactgccctgcaggatgtcaggatgacgccacccccatggcgctccctcatcaaactcctagggaacaaagtccctcctcactgagccccacagacgagccccggtcagcccgagggcccagcatggttggagggtccagctgccctccctgtctgcacgtccacacccccttaccctggacagccctgacgaccgttgtctggtgtcccagagccatggccgccagggctccctgcgaaacaagctcaggccacaggagccccgttcggcccccgcgggaccgcgctccctcccgccggcgacggtccacgcgcggtcaccccaaggccactctggccacggctgcagaccttgagcgtgggaaggggcagccagctcctcgggcccattcgtgatcctcgggcgtcctctggcggccagagcgggcgtgacctcaggagaatccccgccgaggccgaactcgccccgatggccgtttcgctttgtggacggtcgcattttcccagcgggcactgcgaccgactgtgactgtggttccgggtatggtggttgcacgcctgtggtcccagctagtcgggaggctgaggcgggagaatcgcttgagcccaggaggtctgggttgcagtgagctatgacagcgccactacactccaccctaggcaacagagcgagaccatttctcaaaaagaataaaatgacaaccggaaatatacgaccgtgctgtcgcggctgcaggaaatggcggcgtgcccaggcgcactcatgacggctgcgtgctcgtcaaggtgcacaggcgcgcacgcgtagcgtacactggtgaaagttgcgcatttggacaggcgacacgtcctgcgcccgctacccagactctggggaaggcaaggggtgccgctctgttctactccttttccttatccatctcttctgtctttccaaagagatggtgaaagctccacacacaggataaacatgaggaactgaggaacagttaaaaagatgtctatgctagagcttcaacccaggcctccgccccagcctgctgtcccctgcctgcccttccacgtcttatgcacttcgttctgggagcctccatgcatgccctggggagcaagccacacattgccctcgcacggcagtgttccgtcaactggcaccatccagcatgttcagcttggtttctttcctcatcctcataagccactgactctgggttggaaccaccatcacagttaggtcattctctacaatcgctggcctactatgccctgaccgtatcccagtgagcacaatagggtcagaattccaggccactgttgtcccccaacttccattttatcccaaagagacctttcccactagtttcccacagcagaggcgagaccggctggaaaatggaatgaaatttattgaagagaaacgtgtaccgaaatcactgaaaagaagggaaccacaacacagagagaaactgcaaacagccactacaggacacaggtcctaggatccctcctcctggggttcctggcaaggcgcctcgtctacccccgtcctgctgccgaccccactgccacctccctccttcccgagggccccagggcccgcctcttgccaggacggtggactctggcagtgtccaccggcttcagggagccccctcccaagcccatctgctggggcagggccctgccctatagtcatcacagacagtcacaggacaccagtaaacacagcagggaacagcccaccagggcgaggaaacagtcacaagtaacaacaggggtggaatgccaaagcataaagctctcctgggagcctcaggcagggcagccccactccgtcccgggtccggctcttcctcccacagtcatggttaccatcgtggtcacagggtgagcattggccgcgccctggttcctccttccggccatctcctgggtctgtgctgggggcctccggggaggagcagctcagagaagaacacacacagctccacgagaacaagcagccactggcctagatctacaccaggaaagcagaggtggtgtttaagatgcaggacagacagcagtgagcagaacctgggctcacaggaagctcacagcacatgccccgggcctagtggcggccgcccgggtgggtgcacaacacacaactttgcacaggaacgacagctagcagtgggtgggcgtctgctgggcgcgtgggtcactacggggcctaaacaggtgagggtgggcttcccagaacagggggcagcctgccccggggacggcaaatggggcaaccctcttgggagacccaggcagctggcacccttgagaggacctctttcccctgtctctcccaacccaggacaaggggtgggggacagacatcttcaggtgcccccacccaggtcgcagctggccactcagggctccctcctggccagccccccagagacggcagggtttggggctggggctgggtgcagcactgggtgcaaagcaggggtgcctcccccaaccccatttggtatcaacgtggtcatctgggtcaccgggaagggctgatggtggtggccagggccctttggagggaggtggggggccccgatcctgatgtgggatgagggaccagccctggcctggcctccccactgcctccaggatgctgcggcctgagaggagaggaggccctggggccctctgagcctatttgcctggggaggatttgggctgaccaaccttcctggccccatcctcattttccaactcctccagtatgaacataagacccccttgggtcggggggctcctcagcctcctggcctcctgcctggacaagaccctctggctccttcgaggcctgcaggggcattttcaccttccctaatggcaggggtgctcctggcggcctctttggtggcaggagcagtctcagcagcatcttccacgccagggtcagcctggctggtgtcttcctgggctgaggaggcctgagcagcatctccacaggcaggagctgcctgggcggcaactggatcttcactttccactgtggccactggccaggccacaacatgctggctcctcactggggaggccgcccacgcctccatctcctggatgagctgaagcagccccaggaagtagggcggcctcctctccagtgcatccccctcagggtattctggagtgcttcgccagggcaggcctgaggctgcacctaccgcagtcacaggtggttggccagggccgggcagacggcccccttctccagggccatctgcagcaggccttccaggcataccaggaaggcaaagggcccctgcgttcaggtcaggaacttcagcctggaagtcattcgagggtcccggtttccaaacgcctgccccagcaccgccgcccagcagtccagcagcacctggcagtccagtgccgccaagttgggatcttcctctaggaggccgctcacaacgtccagggctgggccacccaagctctccagcagccatctcttcctctccctttccgacgcatggtaccacagctgcagcatatccttggcgtgctccatccagctctcaaaggactcttccttgcagcctggctgctccctccctgaaaagggtctcagttcctggtaggccctgttttccagcacagcctgcagggtgcagcgccgaggctgcacccaggctcttgttacatttgtccctcttgcctcacccacagctcctgcctcaccggcagctcctgcctcacccacagctcctgcctcacccacagcttctgcctcacctgcaggtcctgtatcacctgcggctccctcatctgactctcttgcctcttctgcaactctcaactcatctccagctcctccctcacctgcaccttctgcctcacttgcagatcctccctcacctgtggcttctgcctcacccttacccacagctcctgtttcacctatggctcctgctgcacctgcagctcctccatcacctgcctcttcttcctcacctgcagctcctgcctcacctgcagatctttcctcattcacacctcctgcctcacctacagatcctgcctcacctgcagctcctgcctcacctgcacctctggccactgcttgcccctggggctatgcagggaaactgggtatatcctgaaactcagcatcaagggcctggggcagggagatcactttccagggtccccctttgcctgctatttggcggggaatcaagctttggtttaaaccctcagcgaattccaccaaggctgccctggccccgagctcctttctgaagaccttgatgagcactcggtacctgcccaggggcgacagggcagcccgcacggcctcctggaactcatgttcctcgcagtcgtcagggatatccaggatgagcagagagcgctctgcgttcacacccatcctcctgcaccagtcccgaagcatcgccagagccatcgcagaggacttgagggagggagcctgatcagacaggaatgtgtgctgactgttgcagtctctgacgcagcctgtgagtgcaaaggggagagagggacgttgctgccagtcagcccacccccaccgcacagccagagaccagccactcccaaatgcagggcctgaagcatctcccctgcccagtgtcacagcccatgctcccccacccctactgctgcagctcagagtccttcactgcaccccccacctccacagcaggaagcgcctctttcacctggtgaacagcccctgatcacaaaacttacagctggagcccctccaaccatcatgtgcaaccctgcagctggatgtgcccacctcctctttttcccagcacttgaccaggagccctctccctaatgccatcctccctgcaacctggcaaccccctcccacgcctcccacatcagcagccaggagtccccttcccccacagccagagcccctctctctcccatcgtccccttctgtagccagaggtgccctgcagccaggagctcaccccacccagactcctgcagcaaggagaccctcctcccctctcctcaggctccagaccacaacccgctgtcgcacctactgcctggggggacagcgatctggctcctgcccagtgtgccctcagccactctggggtcccgctggtgcctgctcactgtctgcagacactgcaaccacccacggggaaatgccaccttcaggctgtggagcccactctggaggccgccttgaggccctggaatgggaaggtggaagatcgcgccccagcagcccatctgggactgcacagggcagggatatctcaggccagctgtactaagggcacgtgggcttccaacttctcccagaagcctcagatagatgagggagaaaaatctcagagtctctgtgggaggcaaatagctaaacagggggaggcatccgtgttgccctgggatcgggacctgcgcggtaagggcttgatgtgcctccgggggcaacaggcccaaccatcaaaatggcctagtggaagtgttgagagagaaaggggattggaaactggcagagaggaagcttatgcttaggggcagcgtctggaagctgggagttggtggacagccaggtactaggactccagactaggtcccccaaatcactacattcacaggcctacctcctcattccaggaatctccacaacaggaagaggctagctgttcctgactcaagagcctcatcatagttcttaggctacaaagccagccttcaccacctaggaagccattgcattggaaagagtgtgtacggcctttggaagcaggcaaagctggcttcacctagcagctgggtggctttgcacaaaccactgaacatctctgtttctcatctgtaaatgagcaataagaacatttttcttgcaggggagtcatggagctttaccttctattagacacacggtaagccttcagtaaataaccacaagggcacaggaatgaaaaagggtggtgtggccaagaatggtgtgggtattggaggctggttgttgcagccagctcagtggtcccaggtctgagctctgagaaaaagcaggatgtgagtgggaacattggaaccattttcctgaggaatgcaaggattggccaatgtgaaaatatgactttctgtttctgcaggccttggtcaagagaggcatttgggaaactcagccagtctctgccatgtctaggactggctacccatctggccagcagctttgggagtttcctgagagtgaacccttgatgcatccttgagcactgctgcacaggcaccactgccctcacgtcacttccccagccaccaataggaacaacaggaagagtaagagagtaagggtacatatacatatacacacatatacacatatatatacacatatatatacacacatatatatacgtatataaaaatatatatataaatctctctctatatatatatatagagagagagagagagtagagagagagagggagagagggagggagagagagagagagagagggagggagagagagagagagagatggagtctcgctctgtcacccaggctggagtgcagtggcgtgatctcggctcactgcaagctccgcctcctgggttcaagcgattctcctgcctcagcctcccgagtagctgggactacaggtgcgtgccaccacgcctagctaattttttgcatttttagtagagacaggttttcaccgtgttagtcaggatggtctcgaactcctgacctcgtgattggcctgccttgacctcccaaagtgttgggattgattttttaatgtccctggttctccatttgtaatatgatttcaaaactccttctatcacaagttagagtcagtttccctacctctggaatctaggctggcctagagacttgctttggaaaatggaacatgagagaagtgatgagatgccaattactgttgatcatgggtcacatttccctgttacttcacatgttctgggtttttaaaagttgcatgtcaggcattgtgcttcaaagaaccatagggattagagtacactctttccttggttaggtactatagtttccctgaggtatataacttcaatccaatcagaattcgagctgtaccatggcttgcatacatctttagttagtattagtattagatttcaaacaccctgaaggtaggatttgtgttaaaggctgcttcctccagttgctagagtcaagcagaactttggggcctaaatacaagattgattctctctctctctctctctctctctgtctcaccccagcctgccatattacttctgtcaccacgcactcagaaaaaaaaaagactcattaggagaatccattgatggggagaactagctatgcatttggggctcctacagattccaatgtgtctacccaggccacacagtcattaactgtctttatcccagcaattattgcacctatggccggcacaatcctctgccttgtaagaccattcttaccggagaggacaatggccattgatatgtgtttgtctctctctgaaatttagttactttagacttcaggcagggcacggtggctcatgcctgtaatgccagcactttgggaggccaaggcggccggatcacttgagtccaggagtttgagaccagcctgggcagcatggcaaaaacccgtcactacaaaaacccaaaaattagccaagcatggtggcgtgcacctgtagtcccacttctcaggaggctgaggtgggaagatcctctgagccagggagacggaggttgcagtgagctgagactgtaccacttcactacagctgaggtgacagagtgagacactgtctcaatatatatgagatttttgaccaactgatttttttatagttgttacaatgagattaatgctctgtcatgacctacatcctaaccagaacaagtctactccaaacccacaaagaaatgggtctggagttcttgttcttgagacattttaagtgatctcttttaatcctagaaactaggtggtaggggtattcggtgcacttgaaattttgacttgagagggaaggtgaccctagtggatttataatttccctaagttccatttctgtagagctagggatgttcatattggtggcttacttttgctccctggctttacaaataacaagtggacacaattaagtgccaggtttgtcaatgggaaagttgtgtagacctggttcactggacatttttctgagatgtatattgggttatcaccaagtgaggtgataacctcatcccaaatctgctattaataacaaaaattgcattgtaatgtagaatgctagaacaatgggatattgcacaactaggctcgaggagttaatttggattcagtggacaaggtgcatatgcaattgagtgttcagtaacaaaatttatcctaaaacacagaggaattttgtatccatatttattaccataattgtccacagtatgtatcagtctctcctggagataccacatggtgatagaccagcaagactggacatacttatgctcacagaaacattttctgttctatctgcagtgctatcacagcttacatggtggcacctggggaaaggtaacaaaagcagctgacagaaataagggacccagtggatagtgatataacagaagtgagtaggtggtaagaacttggtatagtggtatggctccacggtttgcacatggaaaataatacatataagctcctaagaactggaacttcactacacccagtcccgaggaggaaatactccatggctctctccctctgtgggaagtggggggactgtggctcctttgatactcatgttgcacccactgagacctgtggtaaaagtgtagctcatcccaggctgagcaaggaagagccattcctccaagcccaaagcagtagaaaggatatcagtcatcattccccactggctgctgtcatcagcatatgcactgagcttgcccagagggcagaagacctgcaaccctttcctcccctttcttgatagtgtccttagatgcacgaacgtttttgtttttgtttttgtttttgttttgtatgaagtccaatttatctattctttcctttggttgcttgtggtgtcatatctaagaaaccattgcctaatccaagttcatgaagatcaacatctatgttttcttctaagagggctgtagtttgagcccttcgatttaggtgtttagttcattttgagtttatataggatgtgaggtgggggtctgaattaactgttttacaagtggaaatacagttgtcttagcaccatttgttgacaagatttttttttcccatagaatggttttggtgtccttgtcaaaagttcacttgacaatatatatacggttttatttatagactctaaattctatttcattgatgtcagtatcatagtctttttttttttttttttcgagacagggtttcactctgttgcccaggctggagtacagggatacagttacagctcactgcagccttgaccttttgggctcaacctatcctcctgcctcagcctcctgagtggctaggaacacaggcccaagtcactaggcccagatatttttccttttttttggtagaaatggtgtctctctatgtttcctaggctggtatcaaactcctggcctcaaggaatcttcctgtcttagcctcccaaagttctgggattacaagcatgagccaccgcacccagctccaaaaaatatttagcctctctgtaccatataaagaccagaaggaaaaataatataaatacaaatataaatttatgcatagtaattaatatttcagtatttttacttagaaataatctagccatttaatgaatatctattacttaatttagcatagcataaggttgtaagttatcccctaaaaattggaaactgtttttaaccatattataaatattgttgaaataaaagttatcatcagaataatgactcgattaaactcaaatttatattctgtgaaatcttaaatatctaacagatacagtgttaactttttgactaggaagcctatataagcttagtaagaacatacccaggtaatataaatatgtatgtttgtattatgcttaatgctgataactcagagacatagctgtttttattaaagcagatatctatttacaactatatctacatctatttagagacggagtttctctctgtcatccaggctgggttccagcaatcctcccacctcagccttctgagcagctaggactacaggtgcataacaccatgtccagctactttttaaatttttggtagaaacagggtatcgctatgttgctaaggctggtctcgaactcctggcctcaagtaaccttcctgttttggcctctcaaagtgctaggattacatgcatgacccactgggtctggccttaagctaactcttctttatcaaagatttactaaatgatgtgatgttgagtttttaaagcatttgggttagtttctaaattcttgagagttttagtttaatttatataagtgcttatttatctccaggatacctagaatggagctcctttaaaggatttataagtttgtttggtaataccatctatagtcaggaaaatatcacatatacataacatacacatatacatacatacatgtatacataaacatacacacagatacaaatacagatcttatggctttatttctaaattttcagccaggactcaggcataaacacaaaaatacaaaactcacggtttaatttttttaattggctttcatctttgacacagctttaaatttttttttttttttttttttttttttgagacggagtctcgctctgtcgcccaggctggagtgcagtggcgggatctcggctcactgcaagctccgcctcccgggttcacgccattctcctgcctcagcctcccacacctttaaattttgacgaagattgtgtttttggtagatgggacaagacggggttacctgctcaataagaaggctgaagcatcccactaatatttgtaaaggagatttgtaagattttcttttgccctgatgtataatccaataagaagctatagactaaattttgggtgagggaccaaagagacatcaagtggatgtctggatgtctcaaaaatccatctgagtggatataatatccacagtggtcccagtgagccttttcatccttgagtgattgattttgaggtccctgagcacctggcgagccctcgatgggggaagggtgcctgaagccctagtgactataggcagctaagaggcctgagtgggaatggaaaggcctgctgaagagtggatagaggggtgcaggaagtagaggtgttgaaggggacagatgaaaaaattcagggagctgaaggaaaggtccaaggtggtgaacaggagggaggagggatgagggagggggagagtgacaagaagcgggaaatcttagataagccggtttagggagaccccgagttctcaaagaggccattgcagttccaaattggctgtaaaattttgccatttctggagctagtgaactgagtcagtgcctttatggctaagcatgtaaacagcggggaagaaaggagaaaaggcgactgacacagtaagaattacccatggaattaacaaatagttaaacaaaagagaagaaaaacttgtaagtgaccagaaagtagtcccacttacttaatttttcacactccctgtgtctgagaacgaagagaacaccccacacagtccttgaattcagaagcctaaggatcccctccccaatttctgggttccaagagccaagggacccactaccacccttctcgatttccagattcagagaggcaagggaaccctcccatcgaatctctgggttcagaaagccaagagaacccctctcaatctctgggttgaagagtggagggaatctccttgcacagtttccaggtaccaggtagccaatgaaattcccacaaaatgcccaggttaggggagcctaggaacaatagaagatgcctcatggaaggtgcaaagaaaagttgttttgccagaataaaactctttagtaccatgttacaagagacaagtgtctggtcactgaattccataagagcgtgtaactcaccaccatgaacctcaatttccccagtcaagaaaggagacaaagagtctgagaagctggtgtggatatccaggtgaagacaggagtagtcagcatgccagcagatatgctgcaccattaactaatacataaaaataaatccctctggatatatacccagaagttggattgttgggtcatatggccattatatttctaattttctgaggaacctccatacttatttcctaatggctgcaccaagctacatccccatcaacagtgtacaggagtttccttttctccacatccttaccaacacatgttgtcttttgacattttgataatagctatcctaacagatgtaagtgatacctcacagtgtttatgattggcatttccctgatgatcagtgatgctgagcaccctttcatgtgcctgttggccatttgtatgtcttctatgaaaaaatgtctattgggtcctttgtacattttataattgggttatttggtttttgctattgagttatatgagctccttatatattttagatagtaactccttatctgatacatggcttacaaatattttcttcaattctgtagtctgccttttcattttgttgtttcctttgctgtgcagaagctttttggtttgatgtagtcccgcttatttatttttgcttttgttgcctgagcttttggtgtcatattcaaactataattgtcaagatcaatgtcaaggagctttccccttgggttttattttaggaattttgtggtatcagggcttatatttaagtctttaatccattttgaattcactattgtgtatggtgtaagagaagggtctaatttctcttttttgcatgtggatatacaggtttccatacaatttattgaaaagtttatccttttgttatcaaactgaactggggtccgctcacctggcacagtaaaaccagatatccacaccaaggtttgcagtggtagaaatgaaggtgcttatttgcagggcactaagcaaggaggatcaggcagctaatgctcaaatccaggcctctccagcggcttgcaggtaagggcttttaaaggcaggagtaaatttcacgaaagcagaagttacaggccaattcataaatcaatatacatggaggttacacgttggttttggcctaaaaggatgggatatcttgaagtgagggggatatcttgaagtgagggcttaaaggctgtaaatagatacagagattttctgatttgcagttggttgagaaactttgtttaaaattttggggtcagcagaaaagaatgctagctctggctcgtgggtgggctgtaactttctccaggcccctcatgaagaaatttggaacaaagaggggtggtcagagttcagtccacagctctaccttttctgaggtttgcatgccacagcatccatttggtgggggtccaagtttctgaaaaacaacttagagacatatgtgaagatgttatctttagtttctataagggaacaaaacatcctgtgattctagcgtcctgggctattgtggtttttgtgtgttttgttttgtttttgctttcgaacttttaagttcagggggtacatgtgcaggtttgttacatgggtaaattgggtgtcatggcagtttggtgtacagattgttttgtaacgcaggtaatgagcatagtactcagtaggtagtttctcacttgtcaccctccttctaccctccactctcaagtaggtcccagtgtctattgtccccttttttatgtccatgtgtactcagtgtttacctcccacttataagtgagaacatgtggtatttgcttttaccttcccacatcaattcacttcggataacagcatccagtccattcatgttgctacaaagaacagattttattcattttatggctgtatagtattccatggtgtatatgtaccatgttttatttatccagtctacaattgatgggcatttaggttgattctgtgtctttgctatactgaatagcactgcagagaacatacacgtgcaggtgtctttatcatagaacaatttatatttctttggatatatacccagtaatgaggttgctgggtcaaaggatagtttgttttttttttaaattgaatattataagaattgcattttttaattacactttaagttctagggtacctgtgcacaatgggcaggtttgttacatatgtatacgtgtgccatgttggtgtgctgcacccattaactagtcatttatattaggtatatctcctaatgctatccctcccccttccccccaccccacgacaggccctggtgtgtgatgttccccttcctgtgtccaagtgttctcattgttcaattcccacctatgagtgagaacatgcgggtttctgtccttacaatagtttgctgagaatgatggcttccagcttcatccatgtccctacaaaggacatgaactcatccttttttatggctgcatagtattccatggtgtatatgtgccacattttcttaatccaggctatcattgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctagttctagatccttgaggaatcaccacactgacttccacaatggttgaattagtttacagtcccaccaacaatgtaaaattgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgttttttcttgtaaatttgtttgagttctttgtagattctggatattagccctttgtcagatgagtagattacaaaaattttctcccgttctgtagattgcctgttcactctgatggtagtttcttttgctgtgcagaagctctttagtttaattagatcccatttgtcaattttggcttttgttgccattgcttttggtgttttagacatgaagtctttgcccatgcctatgtcttgaatggtattgcctaggttttcttctagggtttttggttttaggtctaacatttaagtctttaatccatcttgaattaatttttctataaggtgtaaggaagggatccagtttcagctttctatatatggctagccagttttcccagcaccatttattaaatagggaatcctttccccattgcttgtttttgtcaggtttgtcaaagatcagatggttgtcggtgtgtagtattatttctgagggctctgttctgttccattggtctatatctctgttttggtaccagtaccatgctgttttgattactgtagctttgtagtatagtttgaagtcaggtagcgtgatgcctccagctttgttcttttggcttaggattgtcttgacaatgcaggctcttttttggttccatatgaactttaaagtagttgttttcagttctgtgaagaaagtcattggtaacttgatgaggatggcattgaatctataaattaccttgggcagtatggccattttcacaatattgattcttcctacccatgagcatggaatgttcttccatttgtttgtgtcctcttttatttcgttgagcagtggtttgtagttctccttgaagaggtccttcacatctcttgtaagttggattcctaggtattttattctctttgaagcaattgtgaatgggagttcactcatgatttggctctctgtttgtctgttattggtgtataaggatgcttgtgatttttgcacattaatttcgtatcctgagactttgctgaagttgcttatcagcttaaggagatcttgggctgagatgatggggttttctaaatatacaatcatatcatctgcaaacagggacagtttgacttcctcttttcctaactgaatacccttcatttctttttcctgcctgattgccctggccagaacttccaacactatgttgaacaggagtggtgagagagggcatccctctcttgtgccagttttcaaagggaatgcttccagtttttacccattcagtatgatattggctgtgggtttgtcataagtagctcttattattttgagatacgtcccatcaatacctaatttattgagagattttagcatgaagggctgttgaattttgtcaaaggccttttctgcatctattgagataatcatgtggtttttgtctttggttctgtttatatgctggattacatttattgatttgtgtatgttgaaccagccttgcatccctgggatgaagcccacttgatcgtggtggataagctttttgatttgctgctggattctgtttgccagtattttattgagaatttttacatcgatgttcatcagggatattggtctaaaattctctttttttgttgtgtctctgccaggctttggtatcaggatgatgctggcctcataaaatgagttagggaggattccctctttttctattgattggaatattttctgaaggaatggtaccagttcctgcttgtacctctggtagaattcggctgtgaatccgtctggtcctggactttttctggttggtaggctattaattattgcctcaatttcagagtctgttattggtctattcagggattcaacttcctcctggtttagtcttgggtgggtgtatgtgtccaggaatttatccatttcttctagattttctagtttatttgcgtagaggtgtttatagtattctctgatggtagtttgtatttctgtgggatgggtagtgatatctcctttatcattttttattgcgtctatttgattcttctttcttttcttctttattagtcttgctagcagtctatcaattttgttgatcttttcaaaaaaccagctcctggattcattgattttttgaagggttttttgtgtctctatttccttcagttctgctctgatcttagttatttcttgccttctgctagcttttgaatgtgtttgctcttgcttctccagttcttttaattgtgaatgttagggtgtcaattttagatctttcctgctttctcttgtgggcatttagtgctataaatttccctctacacactgctttaaatgtatcccagagattctggtaatgcctgtgtctagaatgttatttcccagattttattctacaatttttatagcttaagtcttacatttaagttttaattcctcttgagttggtttttgtatatggtgaaagaaatggatcctgtttcagtcttctgcatatggctagccaattattcctgcatgatttactgaataggggttcctttcctcattgctgtttttctcaactttgttgaagatgagatggttgtaagtgtgccactttatttctgggatccctatcctgttccattcgtctaagtgcctgttttgtatcagtaccatatggttttgtaaatgtagtagagtttgaagtcgggtagtgtgatacctctggctttgttcgttttgctttttttctaattctgagaaaaatgacattagtagtttgatagtaatagcattgaatctgcaaattgctttgggcagtatggtcattttaatgatattgattcttcctattcatgaggatggaatgtctttccatttgtttgtgtcatctctgatatctttgagcaatgttttgtaattttccttgtagagatctttcacctccctggttagctgtatccctataggcattttcttcattttgtggcaattgtgaatgggattgcattcttcactgggctttcagcttggatgttattgatgtctagaaatactactgattattgtatcctgaaactttgctgaagtagtttgtcagatctaggagcctttgggcagagactacggagtttccttggtttaaaattatatcatttgcgaagagagatagtttgacttcctctcttcctatttggatgcttttatttacttctcttgcctgattgctctggcgaggacttccagtgctatgttgaatagcagtggtgggagagggcattcttgtctcattgcaattctcaaggggaatgctttcagcttatgccgagactacatgttgaaaaatgtccttgagagcttgactttgtaacacgtggcagtaccttctctcggtctctgccatccagggaacaggaattttggggttcatatcagttagccctaaacattatctcgagcagttaaaaacttttgcaagctcaaaattggctgtcctaggctccttctgagaagaggagtggaaactgcccagtgctatagctcggcagctaaggttttgccgtattataatggctgcccggattcaattcctggcttagggaatgagtcctttctgattgatatctgggtaagatttaccattttttaattctcttctcctccaagaactgtcttgaattttcctttctctgagccagaaatattggtcatttggcctggctaaagttgggtaataagaaatttaaaagaactttttaaaaagagcattatggttaaaagtcagcttaattaaaagcggatattcaagctctaatagcctggacttcttgaggaaaaacagaggaggtgccacagaccctgttttgggaaaaaacctcctctgttttctttgtaaaacccaaggaattgaaagcagatagatccctttccaaatctaaggttctgttctgttttgcattgcattatctgacgttttttactttttgaggtatcagaaattacttcacattataagagagctttgctgtgtaataacaaggtaggaaatatacttttatggatggctaatggcagtcatgaggcaatatgtggctctttgcatgtttggattagaaaagcatgctcctggccacctggaaggtatggagatattcccccactgagagataagggtcccatgggagatgggctaattgcctctttttgggatccaggatctggtataaaaatgggaccttaattttggggaatctgtttttgcctttcagctgtgcctgcttaataggccctacaaactgcatcttttaaaagaaacttaagaaactggcaaatgaaaaatcttaacaactactggttattcttctgtctgtgtatttatatgtgttgtgtgtgtgatgtttatgaaagagctttgattaattggcttaaaaatagtgcttaaatattttatcagaaaaataaaaagcataatgccttttagttcacattactttagtaattttggggaaataaaaacagttttacaagcaaggtgtgtaaggaaagtgaaatgtgtttttggtaaaagattaaaagaaggcatgagaatgtggattttttttagaaggttaaaggattgttttaagttaggtaggaaaaagctgaagatttgagcaagttgtggaaggtttgtgaaaaattaatcttgtaaaagaaattctgtgtgtgaacatattggctaacattaaagggtattcagtttttctgtaaattgaacattggaataaaagcacaacaggcttttcataaagcactcatctgctctttaacaaaaatttttcaagggtttataagaatcttactttatgatgagactttaaaattggatagatttgtgtataaggttttattaagaattgggtttaacatcaatagtgcattaatggaaagggtgaaatgtggctttctctcttgaacaggattttcatgttttattaaaaaataatgaaagatttttgtttgccttttaaataaactacaggaaaagaagggaaagaaaagagacattgtttggaaagctaggtcttccctcttcatgagtaaggggttttgccttttaaaaattttttaagttattattttggcaaaatgaatgacttatggtcacctgggattctattttgtgatatctagtgttttaaacctttgatatttgacaagcttcccaaaatcaaattataaaatatgtctttttctgacctaattaatcttttagatattaggtcacctaaagtccaaaagtgacttttggcttatttggtataaaagtcatacaggaagcattgtcaaatatgaaatggtgtttggccttctttgggctgtgtttgtataaatatgttattggcatgtattccaaaattatggaagctcctataattctgatataacttagtgtgtgttatcaatagttataattgctatgtaaaattgttgtataccacagaggtaatcaaaatttttttgtccattgtggctttaatagtggctgtcctaaaattttgtcatccacagacaattgttatcttgttttaatactcttcagaaggtggttttataatcacctatagaaccctaacaagtgttattaaatgcaggttttctgataactttggagagtgtgacattcagatagaggaaaaactttcaggactcatggacagctgaaatgttcatgaatatcaaacaggacaggagctaactgcatgtattgcgctaatagaagtttgaagtaatcttggctgtttgcttaaaatgttgctgatcctttgttttgttttccagagtcaaggaaacttttgagctatttaaagcttttaacaattaagtaaagtatacacctatgaacacaatttggagcatatggggaaactggttattttaccaaggctttgacgagaatagggtgctttcctttaaggaaaaaaacttgacttatagagccaataaaagccccttgggaaaactggcctcataggttgtctatacagtccctgtacagggttcctgacccgtggtaagtaaagcatgtcactttctcacaggcccaggtgcccccagttatcttaggacctcaagagaagaggaatttacccaactcataagtatttgagagtataaacccacagctgggcttggctttaaaaaaaaaaaaagtcttcagggctcacgcctataatcccagcacttttggaggcagaggcggaggcgggtagatcacggggtcaggagttcaagacctgcctggccaagatggtgaaaccccatctctactaaaaatacaaaaaattagctgggtgtggtggcaggcacctgtaatcccagctacttgggaggctgaggcggagaattgcttgaacccgggaggggaggttgcagtgagccaagatcatgccactgcactccagcctgggtgacagagcgagactctgtcaaaaaaaaatggaaaaaaagtcttatctgagattctttcgatggaacagagttccatcaaagctaatttaaaaataattattcttgctgcactttatatgaatgatcaggccaagtataagaaagtaaattggtcttaccatgatttgtttttaataaaaatgggagactggagatagaaaaactctttcgaacactgtggtacacatgttaatagattctagtctcatcagttgttctgggacttttttcttcaatttagactaaccctgcttattcctgtgaacaaaccagtgacctctgactgctattcagaagaaagaagagggatgggtgatgtaaaaatctggatctgtattctaattctgggcacatattgggatgggctagcaaccccatatcaacttggttccaacaattgtccagttcatggaaagccttttctaatttaatttactagagataattttacttattttgctttcctgttgttgaatatattgctgttatagtctttgtgtaggaatgcaggacaagcttactgaatgtttccctaaactgaacacttattaatcttccagatatcaccttttgttgaaactcaagagttatgaatggccttcaacataccgacactttctaaccgaactcctctctaccctgaatgcaagagacccagtagttaggtaggaatatcatctcccctgttcagcataaagaagttacagaagatggattttcatccctttgcaacccttaggattaagggttctcttgtaaaagggagcagggaaatgtcagaggcatttgaaccaaaacaactccatcttgaataggggctgggtaaaatgaggctgagacctactgggctgcattcccagatggttaaacattctaagtcacaggatgagacaggaggtcagcacaagatacaggtcataaagaccttgctgataaaacaggttgcagtaaagaagctggcccaaacccaccaaaaacaagatggtgatgagagtgacttctggtcattctcactgctacactcctgccagcgccatgacagtttacaaatgccatggtgatgtcaggaagttaccctatatggtctaaaaaggggaggcatgaataattcactccttgtttagcatatcatcaagaaataaccataaaaatgagcaaccagcagcccttggggctgctctgtctgtggagtagcaattcttttattcttttacttttctaataaacttgccttcatttaaaaagaaaagaagaaattaaaccattggttaattatggtgaaatcaataggctcagaacagttcataaccttagagtatagagcaaatcccacacccctccacaaaggagttagaaagaagcagggaactgaagatgtagggtccaggattgctccgtttgcttgataggtcactcaagagggcctttcattatattctatggtaaaattgggaaccgctgtaaagttagttacaggcatgattaaaggatcagtatggtcatgaaaccaaaacagtttgggatgacatacacgacaatcagttaaatttactgaagaggccagagattaggaaaatctaaccatagagttatgtctctatgtgaaacagaaatcatgtttactggttcctagaggggcaattagaatgatatagcaagtaacatatgctatatgccacacacttttaaacaaccagatagtgcaaaaattcactatcacaaggacagttccaagggccatgaggctaaaccattcatgagaaaaccaccctcatgatccaatcacctcccaccaggccccacctctgacactgagaattacaattcaacatgagatttgggtgaggacacagatccaaatcatatcagcatttaaagatagatccaaagattgtacatacctgacagtgtccaactctttgatttttaaatcacttatctgtttaccttgtggctcagaatatagacagggtctcccatacaagatttcataagggcttaattgaagcccgcttctaggggccactctaatcctaagcagtgcaactggcaataccttgtcccatgtccgatttgtttcctgacgaatttttgcaacagtgttttttttaaggtgtggttcatcttttcagtctttccaatggactagggttgccaagaggcatgtaatttaatttccagctgtttggacacctcctaggttatcttggcaataaaggcactcctattatcgctctggatggtgaattgcaacccaaatctgaggataatttcctccattaagattcttactatttctgaagccctctcagtgtggcaggaaaagccttccacctatccaataaataaataaatgtattactaacaactatctaaaattccctttggctcttggcattacagtaaaatctgtttgccaattttctcctagcccattgcctcttgcatgtattccctttggtgtggatgaacccgattttggattattcttggaacagattaaacatttctatatgaccttctatataatcttttgcatattaggacctatgatgcaattctgaatccacctaagtgtggcatcccttccatagtgggtactcagatgaagcaaactaattattttttccattaaaatctcaaggatcagagctggacatggtggctcacgcctgtaatcccagcactttgggaggccgaggtgggcaaatagcttgagcccaagaagtttgagaccagcctgggcaaaatggcaaaaccctgtctgtaaaaaaaatttttttttaaaacacaaaagttagctaggcgtggtggtacatgcctgtagttccagctacttgagaagctgaggtggaaggaacacctgagcctggggaggttgaggctgcagtgagctgtgattgtgccactgaactccagcctgggtgacagagtgagactctgtctcaaaaaaaaagaaaaaaaatatcagggatcagtactgttccttgctggcttataaaccaggagttgggttttaggaccactacactgaaaccctacccttgggttcctcttaaaccttccagagaatatgttggacaaaacagggtcaagtcaatctgtgagactagggccataatagtggaagttttggtccaggctgctaactggtctgctttatttgatttccatgagatattaaacagtttgatttttcgtggctcaggcaatgtatgattgctgacagagcaggagcatcgccatcttgaacaagctcctcattctaatgttcaccttaataaaaaagctgcctaaatctaaagggcatcagcctaatggctaatgtcagcatgaccataaaacacaaataacatctccaacaagaaacatccaaactcctccctgaccagagacatgctagccctgagataacccccctccgggccccagaaagatgtctgccccaagataacttcccctcctcccagagggattccaacccttccataaacttctccacacacctaaacattccaagcttctgataagccacctcaccgtaaaaccaatatatactcttagtctgtaagagaaagtgctcttgaccaaaattggccaggagcacctctcaggttttatctaaagaaaacctgtctttaactgtcagccacgtttcatgtttgtttcctctttctttaattcttacaattgccacttctttaggttctaacaccatttttagtaattttaaaatttcctgcacatgtttgagtcctttttttcccaatgttaataatagccctctttcttcccaaatagccccatgtgcatgcaccatagaagagttctttgaatcagtgtaaatgtttatcttcttaatttttcctcagtgaagagcacggttgaggcattctgggctgacgttacctggtggcagtgcttcagcttcttataatatcttgcaaaattatcactgcatatcccactttccagtttccctggtccatgaagctgcttatatccgtggacatttatagatctgtttttcccaagggcacacctgtttgtcagagtggctggaatagacttgttcaataatttgtaaacagttatgcctaggttccactgatgggtttggaaacagagtcgtggggtttaaggtggaccgtttttagcatcacattaggattatcctagaaaattccttggttttttttccacatctggcctgaagtaaaccaataaccacctttctactctaataatggtaacacacaatgtggggtatgcaagattgtggactgcccccaaggtgaatttttcagcttcttgcagtaagttacaggtggtggtcactgccctatggcacactggctacccctgggttatgatgtccaaagtgtctgaaaagtactatacaggatgcttggtgtctcctagattttgggtaaacacttgcaaccatattccttgtcttttgtgcacaaatagatccaacggctttttgaagtctggcatccctaaagccagagttgctaacaatttctcttttaccaactgaaagcctttttgacatttggcagaccatactagaggcccatccttcattcccttcagcatgctatacagagattttttccatcaacctgaaattaggaatctatataaggcaaaattcagccattcctaaaaaccctcataattgtcttttggtggatggcatagctatggctactgctccccagcagttggggagtaaattcctctgtcctttagttaagtcaaatcctagatacctttccaagggttgagaagtttgtactttcttttgggataccttgtaccttcactcagccaggaaatttaagatggttatgttattttcatctgaactttactttatttgctatcaatgtgccatctacatattggaagatagccccctcttgtaactggagttccccaaaaaagatgagggagtttttgaatccttgtggcaacagtccagcaacattggtgcttgctctttgtttctggatcttcccattccaaagcaaagagttcttgagattcaagacttggggaatggaggaaaaatgcatcttttaagtctaatactgtgaactaacagaagtctcctgacaagatagtcagcaaggtgtaagggtttgtaacaactaggtaacctcctctactatttagctttttaataggtaagatgggagtattgtatggagagctacatggcctgatgagctggaactctggaaaggcagtgattaaaggccaaatcccccttttaatctgttcctttaggggatatagttttgagtttggagtttttgcttctggttttagcttcatctatactggtatagcagggatatagtttggatgtcccctacaaatctcatgttgagatgtaatccccagtgttggaggtggggcctggtgggaggtgtttgggtcatggggtggaatcctcatggcttggtgctgttttgtgatagtgagtaagttctcacaagacctggatgtttagaagtgtgtggcaccttccctgctctctctctctcttgctcctgctctcacctgcttccactttagcttcaaacatgaattaaagctgcctgaggcctccccagaagccaagtggatgctgacaccatgcttcctgtacagcatgcagaactgtgagccaattaaacctattttctttataaattacccagtgtccagtatttctttgtagcaacacaacaatggtctaacacagaaaattggtactgaggagttgggcattgctatagatatctgaaaatgtggaagcagctttggagctgggtaacaggcagaggttggaagggtttggaggtctcagaagaagacaggaagaaagttccaagaaatcttggaaattcttagggactggctagatggtggtaacaaaaatactgatagtgatatggatagtgaagtccaggctgacaaagtctcaaatggaaatgaggaactttttggtaactgaagcaaaggtcatccttgtaatgccttagcaaagaacttggctgtattctgtcatgccctagggatctgtggaagtttgaacttaagagtgacaacctagggtatctgacagagaaaattcttacgcatcaaagtgttcaagaggtggtctaactgcttgtaacagcctatgcgcagatgcaggaacaaagaaataacttaaagttgggaattatatttatagaagaagcagagcataaagtttggaaaatttgcagcctagccatctggcaaagaaagaaaaagctttttcaggggaagaatccaagaaggctgtggtgtaaccactttctagagatattagcctgattaaaagcaaacaatgtcctgatagccaagacaatgggggaaagaccttgaaggcatttcggagatctctgaggcagcccctcccatcacaggccaaaaggcttaggagggaagaatggtttcaagggtcaggcctgggatgccactgccctgctcagccttgtgacactgctccttgcatcccagctgctctggctctagctccagctcaaatgggcccaagtacagtttgggcctccactccagagggcacaagccataagccttggcagtttcaacatggtgttaagcctgcaggtgtacagagtataagggtgaagaaggcttgacagcctccgcttagatttcagaagatgcatggaaaagcctgggtctccagccagacacttcctgcaggggtggagccctcacagagaacctccactagggcagtgcagggggaaaatgtagggtttaagcaccgcccacagagtctccaatggggcactgggtagtggagctgtgggaagagttcactgtcctccaaatgccagaatggtagatccactagcagcttgcactctgcaccaggaaaagttacaggtactcaatgccagcttgtgagagcaggctcagaagctgagccctgcaaagccacagggtcagagctgcccaaggccctgggagcccatcccctgcagaagcatgccctggatgtgagacatggagtcaaaggagactgttttgaagttttaagattcaatgactgccctgctgagtttcagacttgggtggcgcctgtagcacctttcttttggaatgagaatgtttacccagtgcttgtatctccattgtatcttggaagtaaataacccattttgattttacaggcttctaggtggaaagaacttatttccagataagactttggactggggacttgggacttttgagttgtgcaaccgcccaaggggttcaccttgcctgctgcctagacacagcttatttatcaagacaggggaattgcaatggagaaagtaattcacacagagccagctatgcaggagactaaagttttattattactcaaataagtctccccgactattcggggatcagagtttttaaagataatttggtgggtaggggcttgagaagtgggaagtgctgattggtcaggatggacatggaatcatggagagttgaagtgagtttttcttgctgttttctattcctggatgggatggaagaactgattgagccagattactggtctaggtggtgtcagctgatccatcaagcgcaggggctgcaaaatacctcaagcactgatcttaggttttacagcattgatgttatcctcaggagcaatttggggaggttcagactctagtagccagaggctacctgtcccctaaaatgtaatttctaatcttctatctaatttgttagtcctgcaaaggcatacttgtccccaggcaagaatggggtctttttggaaaatgtctgttatcaattttgtttcagagtcaaaccataaattgaattccttcccaaagttagtttggcctatgcccagtaatgaacaaggacaaaggttagaagcaatatggggttggttaggtctgatttctttcactgtcataatttcttcagttataattttgcaaaggcagtttcattaatgctggaatgtgttaagactttggaggactattgggatgagattattgtatttcacagtatgagaaggacatgagatttgtgggggcaggggagaatgacatagtttggacatgccctccaaatctcatgttgagatacaatccccaatgttgaaggttgggcctgatgggaaaggtttggatcatgggggtggatctctcatggcttggtgctgtcctcatgatagtgagttctcacaagatctggttgtttaaaattgtgtggcaccctctctcctccatctctctcttgctcctgcttttgccatatgatgtgcctgctcctgctttgccttccatcatgagtaaaagctccctgaggcctccccagaagctgagcaaatgccagcactatgcttcctgtacaacctgcagaacactgagcccattaaagctcatttctttataaatacctagtctcaggtatttctttatagcaatgcaagaatggccttaacacaagcagtcttagcccttcccagcctcccatcagcccaagcatctgggcttatctgctttaagatgttctccataatattgatggtgtgtttttctgctctgtggtcataaagggcatttgggagtgcacaagcttgttctggtggcacctcaattttcccaaagcaaaggttactgtggcaattaacttagttaacaagtcctgtcccagtgaagggattgggcattctggcatgtacaagaaactatgctttagtttgactgtgcccacttggtagtccataggttgtaaaaaggactttttcataagtgttccagacaccccatgatagtcatagtattgggtgacaattttgttattttgatatttaggactgtattagtctgttttcatgctgctgatgaagacatacccaagactgggcaatttacaaaagaaagaggtttaatggatttactattgcacatggctggggaagcctcacaatcatggcagaaggcaaagaggagcaagtcacgtcttacatggatggcagcaggcaaagagatggcagcaggcaaagagagagagagcttgtgcagggaaaaccccatgattcaattatttcccaccaggtccttcccacaacacatgggaaatatgggagctacaagatgagatttaggtggggacacagagccaaaccatgtcaaggaaggagtacgtggctccaatatcaatcaagaaatcaacttgtctttttcccaccaaagagttacccagggttccaggcaggagatggggatgcagcctcatccacctattgtaccccctgagaccccatcactctcttggatacctctgacaaaagtaaagccttttcttctttcccctgggattgcctttttaaactcaggaagtccttttccaatggtcctcttgtttacaatatgcacaatgcttgggccccatctatggatcgcctttctggaggcctttcttgtttccaggggtgtctaccttctcattgggcttctttacttcaagtgctgtgaacagagcagcaaccaacaaagatgcctgtttttccatcctctgttgctctttatgatccaatgcttgatctcagtttttgaacaccttaaaagcaatctatacagttaagagatagacattccaaaaacactttctaatttttatagctttttctgaatgccaggagtgctttgactaataaaagttatgttaattaatctgaggttctcaggggcctcaggatctatctcagttgacattgccaggaggcttcaaaaattatctccaaaaactttcagatgagttttcatttggcctctgtcacatttcctgaaatttattaaagctacactactttgagacccctttcctcaggactgctaaaattcaatctctttaatgcttgcaatgagcttgactctcatgatttggatcctatcaggatcttgcacatgccagaatgcccagtcccttcgttgggacaggacgtgttaactaagttaattgccacagtaacctttgctctgggaaaattggacattgaggtgccaccagaacaagcatgtgagctccaagatgccctttttgaccacggagcaggaaaacacaccaccaatattattgagaacatcttaaagcccagacacttgggccaatgggaggctgggaggagctaagactgcttgtgttaggctatagcctcagcagtagctgcccagaccagattgctggcagtctcagtatgttactggtcagcttcttctctagctttttctaaaactattctccactctttggaggtaagtagtgcattttgtaaatattgcacattctcccagttaggattatgagtagtgtaaatggagaacacattttccatcctccttgggtcaccccagtaggtaagcatgttatccttccaatggtataggtcagagactgagaatggcacgtgtacccacacaggtcccgctggctgaccctgggcattgattctgccaatgggtacttgcctaatggaattgccctacctcaaccagagtggctccctgacgatattgagtgccctgtcaggtgtgtgaaggagagagcactcctggcctgtttacgtcactattattccccagtccagccagggtaataggggctcccattcctgcctgagcaggggggcggggccattgctctggcttccatatctcgccccccataaggtggagagataggattggtgcattcatttgttgaagtagtaagtcatcttctgatttttgagaaccgggtaaaacctttacctctttcaccttagaggcatttctttcaaccatgattctatgcaaattataccttctttgaattagctcactttggtacaaaagcataaaagcttgtacattcagaatttcatcccatttaccttcttgttcacaaaacaattctaattgaaaaattataatgtaatttagatatctaaattctggctaccattccctggatcctaggggataccgtggtcaggcagaatttcaacattaaaaacatttttctttttcatgggctcaaagctaaaaatggcccgattctgcagaatgcaccataatgggctacaaggaggaacataatttgtagtttccattttagatgacaagaccttaggtgaaaaacccttaatgcctcagctgggctttaggcagattgtcaagcaagcaaatcaaaatcaaaatgtgatttctcaaagtctccatcccttcagttgcttatggagtattccctactaaacacactatgatgaagcagagtcccgtaaattgccaaagcaaggccagatgtcctgccaatgcagaacgtagtgtttgaagaaaatataccttggggctattgcccacaaatttgtcacctgccaaaaaatgtcttcccagccaagtgtctcatttctaatgctgcaaaagtaaaagcaacacaagccagtgatgccttggtggcagccaaatacacagatccatccctgaataaaataattcaggcagctactggacagggtccaagggtgctcatagccaggggctgatatgctattggcaagacacccactcagggcttttgagttgtggccaagtgttattgaactgaactggagttgtcttgcccatcacagtaagatcagatatccacactgaggtttgcagtggtggaaaggaagacatttatttgcagggcactaagcaaggaggatcaggcagctaacgctcaaatccagagctccgtgatggcttgcaggtaagggcttttaaaggtaggagtaaatttcaggaaagcagaagttacaggctaattcataaatcattacacagaggttacccattggttttggcctaaaagggtgggatatcttgaagtgagggcttacaggccataagtaggttcaaaggtcttttggtttgcagttggttaagcaagagaagctttgtttaaaatttttgggtcagcagaaaagaatattagctctgacagatggatgtgatttcctccaggcccctcatgaagaagtttggaacaaagagtggtggtcagagttcagtcctcagctcccccttttctggggtctgcatgccagctgatcagtttggtggggatccaagtttctgaaaaacaactcagagatatatgttaacatgttatctttagtttctatagggaaagaaaacatcctgtgattgtagcttccttggctgttgttttaagctattaccttcttgcttatcaacttgcttatttacttctcagggctagctaggtgcctggcattgcccctgaaagaactcaacattttcctttatttatatgcttaagggggcctgcagacccctgagacggggtccctgctccatctcactttcctcattgtgtattcttggcagctttgttgaaaattaattgtccatgtatgctactgtatgatccagcaattccactatggatagatatcctaagcaaataaaatcactatctctaagtggtatctggactctcttgtccatttcagcattattcacaatagctaagataagaaaacaacctaagtgaccactgacagatgaatggataaagaaaatgttttttatatatctatattatatatattatatataatatatataatatattatatataaatgtcttatatatatttttatataatatttaatatataatataatatatattatataatatatattttatatattatatatattatatattatatatatattatatataatatatataatatatatttatatatattttatatataatatatataacatatatttatatatatattatttatatatattatatatatattttatatatattatatagtatatgtattatatattatatatattatatataattttctttattatatatattatatataatatgaatatactatatattcatatcatatattatatattcatattatatatataacatatatatgttatatatataacatatatatgttttatatatgttttatttatatatatatatatatatattcacaagcagccttaaaaaaagaaggaaatgctgcccttggcaataacatgaatgaaccttgaggatattatgctaagtgaaataaaccagacacaggaagccaaacattgcatgctcttgtatgtgaaatctttttttgtttgttttttgagacagggtctcattctgttggccaggctggagtgcagtcacagctcagtatagcctcaacctcccgagctgaagcaatcctcctacctcagcctcaggagtagctgggaccacaggcatgtgccatcacacccagacactttttaaattttttttgtagagacaggggtctccttatgttgcccaggctggtctcgaactcccaggctcaaggcatcctcttgtatcagcctccaaaagtgctggggttacagatgtgaaccactgcagccagccatatgtgaaatctttaaaaagtgaacgtcaggccaggcgtggtggctcacacctgtaatcccagcactttgggaggcccaggcgtgcggatcacgaggtcaggagcttgagaccagtctggccaacatagtgaaaccccgtctctactaaaaatacaaaatattagccgggtgtggtagtgtatgtgcgcctgtaattccggctactcaggaggctgaggcaggagaatcgcgtgaacccaggagtcagaggttgcattaagccgagatcgcaccattgcactccagcccgggcaacagtgggagattccatcaaaaaaaaagaaaatgaaaaagaaagtgaaactcacagtaacagagcagagagtataatggcagttatcaagggctagggtatgaagaaaaggggagatattagtcaaagggtacataccttcagctataagatgaataagtattggaaacctaatgtatagcatggtgactctagttaataatactgtattgtacttgaagtttggtaagaaagcaggtgtaagttcggtaagaaggtatgtgtctcgtcacacatacaaaaaaagtaactatgtgaaatggtggatatgttagctcattgtggtaatcatttcacaatgcatacatatattcaaacatcacattgtatgccctaagtatatacatttttatttgtcaatcataccttaataaagtttgggaggaaaagaatcacaggacttaatgagagataatttatttgaaaggcttcttgcaactgggggaggggatgtttcaatcgggtgtccaactgtcagttccacaagcaactcaagggtcaggcaaaaaggagctttaaaaaaaaaaaaaaaaagaggtcggggggaggagcaaacaagcctagaaagaacttggtgtgaggatgtggaatgaccagatattagatcagagaatgttctacctgggaccagcctatgagaagggcctgttaaggttatctgctggctcaaactaaaggtgggccaaatttcaggagtctggagaaagaagagaagctacctaaactttggctaacaagcatttttttttttaatctcgctctgtctccaggctggagtgcagtggcgccatctcagctcagtgcaacctccactcccaggttcaagcgattctcctgcctcagcctcccaagtagctgggactataggcacgtgccaccacgcccaggtaatttttgtatttttagtagagacagggtttcaccatgttggccaggatggtctcgatctcttgacctcgtgatccacccgcctcggcctcccaaagtgctgggattacaggtgtgaaccaccgcgcccagccacaagagaacgagcagttcagtttatcatttattaagtaaagaatggcaatttggagggtctcgtgtctggcattgtcatacataaacacgggtgacatcccctaagtcttatctaagtcatatggaaaggagggttctttgcaggaagctgttttctggaacacaaagggctgagggtttcttaaccttcactgttttccaggatcacagggctcaggaaaaattcaacattgtcactatccccaataactttttttaaagaaaagtgctatggtttgaatgtgtcccccagagttcatgtgttggaaacttaatccccaatacaactgttgagaagtgggacctttaagaggtgattaggtgaggaggactctgccagtgtgaatggacaaatgctgttatctcgggagtggatttgttattgtgggagtgagttcctgattttttttttaaaaaatgagtttaggcccctttcttctctttcttttgctcactcttacacatgctttcacgtcttgatgcctgcatgccaggccctcagcaggtgcagccccttgatcttagagttctcagccttcagaaacatgagctaaataaattcctgttcattatatgttacccagtctcaggtatttgattatagaagcacaaaacagactgagacagaaaaaagagagagagagaggaagctagtcttctagtgagaaatagaatgaattgaagtatacgtctggccaggggagcacccagtagcccagaggtgactgaggcagaacctctttccaaaacatcaccttctgtgatgttgtgataccaggcagctaagcaatggctttcagcactattttctccttgtcacatgaaggagattgatttaatgggctctgaattgtctttttttttttccagacaggatctcggccaggcacggtggctcacacctctaatcccagcactttgggaggtcgaggtgggtggatcacgaggtcaggagatcgagaccatcctggctaacacagtgaaaccctgtctctactaaaaaatacaaaaaattagccgggcgtggtggcgggcgcctgtagtcccagctactcgggaggctgaggcaggagaatggtgtgaacccaggaggtggagcttgcagtgagccgagatcgcgccactgcactccagcctgggtgacagagtgagactccttctcaaaaaaaaaaaaaaaaaaagacaggctctcactttgttgcccaagctggagtgcagtggtgtgatctgggttcactgccacctctgcttcccaggtacaagcgattctcgtgcctcagcctcctgagtagctgggattacagctactcagctactcagattacacacccagctgattttgggatttttagtagagacggggtttcgccatgttggccaggctgatctcaagtgatctgcccaccttggcctcccaaagtgctgggattacaggtgtgagccaccacacctggctgaagaaggtgatatctgcaaatatctttctcagtgaccataaatttaaaatgttgtccgcttttaacatatttattaaaacagtaccagaaaaagccttttcttttttaatcacagagaaagaaaaacaaatatattctgtcactaaaggtccacaacttctggccctgaaatgtaatcataggcttcagacccttgctccacacagcctgggcagggatatgcagcaagtaacctagctttcagtggaaccatccctgcctcagatctcttcacgcatttttttaagattaccaggggatttgtgtgcaccttgaagtgtgctacctgtgccgcacccacacccttttctggaacagtactttcgggccgctgcaagccgcaggaccttccctctgtggaagaaacctgctttgggaaacgacaggaagcagtttgggtactaggtgcgtaatgtttggtcgtgaaatcaggagaataatgggagaatggaatattttcagtcatctggctctcagtgagcagcgaaaaaaaactaatgcccttgtgaaatgcaggcagtagctgtattttttgccctcctcccctagaacagtccaataaaaaataaacgagggctatgactcgtttataagggcgctcacgtggcctatacgttgcactgggtgatttgcacccggcccttcacccatgggcttgggacgccacagctcccctccaatgaggaagagccacagtggctgctgggccaaatggcacgtggcgagcctggctgccaccgtcgtcggcacgggggtgggtggggtgaggaaccaccttgcaggaagtaggagggtttatgtcaccagtgcgcaaccgtgagcgggccgtgtgcagttccgctcatggggtaggggggcggtcgtcaccagacaacctcttcccgccacagcctcgtggcgcagtcagcacggaggcggcagccgccatagacgtgtggtggtcgcgctgcgcgggaactccggcttggaggcacctccggcaggtacggagctggaccccgggctcggacagcaacccagattacgggggaaccccccagtaactcttgctattttccacggggtctaggggctggtggccataggtttccctggaggcgggatcccactagatcacacccagcacgccaaggaatccctgccatttccaggcagaacttcagggagacctggccgggcgcggtggctcacacctgtaatcccagcactttgggaggccgaggcgggtggatcacctgaggtcaggagttggagaccagcctggccaacatggggaaaccccgtttctactaaaaatacaaaaagtagccgggcgtggtggtgtacgcctgtaatcccagctactcaggaggctgaggccggagaatcacttgaacccagggggcggaggttgcagtgagccgagatacgctactgcactccagcctgggtgacaaagccagactccgtttcagagaaaaacaaacaaacttcagggagacctattccacccttgacctgcccggagacactgcagtcaggatagtagctcttggcccttgcccttgagggaaagtggcttcgaaccttcccctcctagattctgcctgcttccactgatgtcggtggtgtgggtgtatgtagataaccgggtggggattggggggagcaggggaatggaggtaggggatttggggatatcagttagacttgcctcggggtaggagttggacttggtgagggggcagggcttggggtaggagttggactgtgggtgggggcagggcttgaggcacgagttagacttgggtggtggaaggggttagacttggtggggggctaagcttggggtagaggtgcaacttagttataggcagagtttggcagcaggggtgcaggttttgaggtggggcttaggaagggttgcaacatggctgtaggggcggagcttgggagggaatggagtttgcagtgggggtagggcagcaaccttaccttaggatcccttctgccctaccagcagcccccctgcccccaccccctacctccctcctcacctcccacccctctcaccattcgtcccccgactcctccccccgctccgctccctctgtcagttgagcagtttcttctatccctgcaccagggtcctagtgaacacctatgcagagtctgaattggcatggcctgggcagggacatgtgtgtgggacagaatcacagcaaaatacctctgctttgccttggacagatccagtgaagcaggacccatcacgcctgagtcaggaactgcctaactggatagagttgaaaagcagagcgagtctgaagtggctgtgttattgcagcatccgcgctgccagcagggccaacccagcaaggtgagcagctgtgagttgggccctgttgggaggggctctggaaccctggcaaagagtggggagaggggactgcctgccagggttcacagactctgcagggtagggccatctctagggcaagagttgttggtttcctgcagtctggcagtggggaccttatctgggtcccttttctgcctgatttcagcttccacacaattgaaaccatgagctcctgtcctttcagcactcactcctcatgcccatctcgccttccctctcccaccctcctttttgctagtacgctttattggttggaggccaatgacatcacctgttgcttttcaaggaccttggccttaccacatgacactcccctgcaatagcaacccatggtccatggtattctctgtatccatggcaacactgcagcttgtcacacaatctccacacccaccactctcattgcattgcgcagagctcagccatctttctcatccgtcaggcattcctgagaaagagggccactctacctctcttgctgccagccttcactccagcaaggagggtgctgggtgacctgagcccacatagccccgagtgagcagtgaggctgtctcctgccctcttctgcctggagggctcgtcagtgtccccaggtgtcaggccctgcctcctgacgttggccttttcactacaggcacccgaagcacacacagcagagtcctctggactttgaggaagaacccacagcaggaggaagtcagcagggagtggtgagatggggagatctttgcctggggagaacctccacactctaccctccccaaaatgacttggggaaccctgggaagaaaggactccatccctgcttgggggtgggggcagaggaggggtgcttgggggcgtaggttggggtgggcattaacaatgctctcatcccatttgctttgcaggctgtgtgaaacctgggaccacttctgccttcctacgtggcagtggctcagagttatttgagtgctgtcaaactgagctgattgctgccctagtattagatcagtccatagaaagtgggagcaatggcactgacactgctagaggattggtgcaaggggatggacatggaccccagaaaggccctgctgattgtaggcatccccatggagtgtagtgaggtggaaattcaggacactgtgaaggcaggcttacagcccctgtgcgcatacagggtcctagggagaatgttcaggagggaagacaatgccaaggcagtcttcattgaactggctgacactgtcaattacactactctgcccagtcacataccaggaaagggtggctcctgggaagtggtggtaaaaccccgtaacccagatgatgagtttctcagtagactgaactacttcctgaaagatgagggccgaagtatgacagatgtggccagagccctgggatgttgcagcctccctgccgagagcctggatgcagaggtcatgccccaagttagatccccacctttagagcctccgaaagaaagtatgtggtacaggaaactgaaagtgttttcgggaactgcttcccctagcccaggcgaagagacctttgaagactggctagagcaggtcactgagataatgcccatatggcaagtgtctgaggtggagaagaggcggcgtttgctggagagcttacgtgggcctgctctgtcaatcatgcgggtgctccaggccaacaatgactccataactgtggagcagtgccttgacgccctaaagcagatctttggggataaagaggactttagagcctctcagtttaggtttctgcagacctctccgaagattggagagaaagtctccactttcctgctgcgcttagagcccctgctgcagaaagccgtgcacaagagccccttgtcagtgcgcagcacagacatgattcgtctgaaacatctcttagctcgggtcgccatgacccccgccctcaggggcaagctggagctcttggatcagcgagggtgtcctcccaattttctggagttaatgaagctcattcgagatgaagaagagtgggagaacactgaggcagtgatgaagaataaggagaagccatcagggagaggccggggggcctccggtagacaggcaagagcagaagccagtgtctctgcacctcaggccaccgtgcaggcaaggtcttttagcgacagcagcccccagaccatacagggaggcttacccccattagtgaaacgcaggcggctgttaggcagtgaaagcactaggggagaagaccatggccaggccacgtatcccaaggctgaaaaccagactccaggcagggaggggccacaggctgcaggagaggagttgggaaacgaggcaggggctggggccatgagccatcccaagccctgggaaacataggctcagaagaccgaagcactccttcccctggcaggcagcagggacatttgaacaaggggaaggggcagcttacactaacagggaacttgactggggcagagggacagggaagccaggtcgagatcaagcccccttactttccaccagctggaagggacttcaccaaccaagaccaaatagcatctggttcagtgggggccgggcccatagcccctaacaggtacaggagacacaagcggggaaccactacacttagcacatggggtgcctgggcttcagatggggaccccagcgaagcaggggctgaagaaggtgtggctgggggctctggcctggtcctctggacacccccaaatatctaccctgtggactttgagctgagcatgcccactggcacccaggccacgtgggacctggaggagcctgcctggggcctgcctctgccagaaggagccagggctgctgaggaagagctgtggggcagaagtgaagccccgcaggggaggccacagggtccagcctgtctttaggatcatctacactgcatgaggggagccccaggaaggcagcattcataagcccctgcaccagtgaggaagagaaagaggaggagaattaagaagaggatgatcgggaggaggaagaggagaataaggaggagcaggaggaagagggggaggagaaggaggaagagggggaggaggaagaggggaaggaggaggaagaagtgtaagaagagaagagaggatgtgttgggggtgggtagttgtttttggtttgcgtcatcatcaggcccgggctctgctcactgctgttccgtgtcaagaactccacctctgctttgccggtgtagatctcggccagtggctgcttgttctcttggggatgtgtgtgtttttatctgagcagctcctttccagagtaccccagcgcagttccaggagacggtgggaaggaggcatggcagacgctcaccttgtgactgtgacctcgactgcaggaggaccaaccagacacgggaaggagcagggctgcctgaggctccccaggaagctttgtgctttggcgttccacccctgctgttactcgtgactcagtttcctcaacttggtggggtgttccctgctatgttttccagcatcctgtgactgtcctgtgcagtctatagggcagggccctgccccagcgggtgggctcaggagggggttccctgaagcgagtacacattgccagagcccaccatcctggcaagaggtggatcctggggccctatggaaggagggatgtggtggggggggccacactgagggaggggccggggacttgtgacctgtagtggctgtttgcagtttctctctgtgttagattcccttttcttcagcagtttcagttcatgtttctcttcagtaaattttgttcagtgttccagtggtgtcttgcctctgctgtgtgaaactggggtgggaggtggtctgctggggatggggccacagtggccaggctgacatcgaggtgtgtgtggggcagggtctatgagggcctgtggggtgccttgggctgcatggagcctggcaacaggatgctggtggtcatgagcagtgactggctgggtaccaaaggcactccaggtgtcctcaggaataagtgacttggacattgaaggctgggcaaggggcagcaggtgggtcccaggcccctgatccctggcagcactgtaggggtgtggctcaaggcttccggaagggtcagagaggccacgtgtgcaaccaaggccagcaaccgaggtcagagaagagccccaggagggcctggacaggcagtcagaggccctgtgaagagctgtgtgcaggactcggggtggggtaggggctggtgtgtgcccatcctcccagatcagcccgcaggtggccagccttggcctagccactgagggatgtttggggacagtgtgtgtgtgatggccaaggggacagagtgtgggcgagaaagggatcccaagtgctcatgtcttggggagggggagaggaagggcgggggagctgcacttcatcctgggtcctgtcctgctcccttcccagtgtactgggaggcgctctactcctgtgtcctgggagcaggcagtgggccatgagcaggaagcctagatggccctggggagtgacccctttctgtcctgcatccccgaggccctctgagccctggatgctgcctgaggagggctccctcaggatggacggcgctgctaatccagacacccctccttcagcactgtggccagaggggcagttcttggtgggggcctgaggatcctggaacccgccctcctgagccctcctgggactggctctctctcccaacaggccagggagctcgccacaaatggagggtagtcctcgatcagccatttaactagcccagagtctgtgggcgacagaactgggacaagtgataggcccctccctgcacatgtgtggggaggggacgggatcattgacttggacgtggcgagggtctcccggggctcactcagtctgtgtccacacacttcctccggctgttctggagcacagagcctccggccatccccatggctcagatgatagccaggctcccccaaagcagcctcagagccaatgctgggaatgggtggctgcccacctgggctgaggaatcctggatctaggcgacctgtctgcttgagcggagctgcagtcagcaggtctgcagggcggcaggggccctgggagacactcggcatacacaggccagtgcaggcatgggaggggtagttttgcggggctgtcggggaggggcagggggcggcaggtctctggggctgggcctgcagcctccccggcctgaaggtgcttaaccggtgtctcagggacccttgtagtgtgtcccatcggggtgccctgcaggcatgcctggggcccccactgtgctctgttctccctgccttcttcaggctgggcacaaccccagcatgtccgtcccttgtgtctcagcagggccaagtcaactgctcactttccaagggcccctccagattttggggacagggcaagaggagagggcatagagcttggctgaccttgccagggcctgtcagggctccttggttttccctgttcagagtggacctgtgtgtgccgtgattcccaagcaggtgtgagtgtgagtgagcgggtgtgtttgagcgtgtgcgtgtgtgtgtcagtgtgagcatgtgcatgagtttctgagaatgtgtgtgaatccaagtgacagaatgtgactgcatcactgagcgtgtgtgagtgggagggtgtgggggaatgaggctgtgccattgaaggtgagcatgcatgtcgctgaatgtgtgtgacactgtgagtgtgtcagtgtgtgtcagtgtgtgtgtgagtttgtgagtcattgtgcgtgcgtgcgctgactgcaaatgtgggtgtgtcaatgagcaggcatgaatgcgtcattcaatgtgtgtttgtcactcaatgtgtgtgcgcatgtgagtgtgtctggaacatgagtgtgtgagtgaatgtgtgtgtgactgtgtcagtgggcatgtgagcacacaggctggacagttgggttgtgaaacccggaagggatctagccagggagtctggaaggaggtaccgggagaaaccagttgcttccccaccagcccagagcaaggagactttgtcgggcctgaaggacgggcccccccggggggccacctgtccccttcatcccagccaggcccttggtgcgtgccagctggcagagctcctaccatgcattgtgttttgctgcacagtcctcaacaagtgcccctgaggagggcggcatgtgtggcctggggacagaaaggtccatcaaggtgccttcctgggtgcccaagggctgaccaagcccatccaataagcagcagcctcctgggctcacagagggcttgagcggtggatgagggagctggatcagagcccaatcatgggggtgaggctgagcagagaggactcagagaagtcccgtcctcaggactgtcccggagtagacaagactgagaggggtcccatcctaaggcctgtcccctcagcagggaggactgagagaggtcccgtcaccaggcctgtgcctgatcaaagtggtctgagagaggtcttgttctcaggtctttccctcgagcagagaggagtgagagaggtcctgtccacaggtatacctctgagaaaatgaactgagacgggtgccatcataagacctgttccttaacgagagaggactgagttgggtctcttgagcagacaggcctctctccaaaccctgagcggtgggaactgggaaaggtgctgtcctcagctctgtccctgatcatagagaaatggcagaggtctcattttcaggcctgttccatgagcaaagaggactgaaagaggtcccatactcaggtgtcccctgtgcagaacaacagaaatgtctgacagagtacaacccgcaggtctctttctgatcagagaggactgagagaggtcccatcttctagtctgtcccctgagcaaacaaaactgagaggtctcatcctcaggcgtcccctgagcaggaagactgagaggagtcctgtcctcagacccatccctgggcagagagtcataagagaggtcctgtccacaggcccatcctctgtgtaagaggtcagagagggatcccatcctaaggtctgtccccttagcagagaagactgacagcggtcctgtcctcaggcctgaccctgagtagaaagcagtgggagaggtgtccccgggcagagaagactgagagagatgctgtcttcaggtacctgaggcttagtgggcagagagaggtcctgtgctgtggcctgtcttctgagcacagtcgactgagagaggtcccattcccatatctatcgtagagaaaagaggacttagaggggtcctgtcctcaggcctgtcctttgagcagagaggactgagagaggtcctgtcctcatatctatcccctaagaagatggaccgacgggggtcgcatcttcaggcctgtcccctgagctgagggggctgagagggttcctctcctcacacctatcccctcagatgatggaccgacagaggtcccaaactcaggtctgtgtctagagcagagaggactgagagatgtcctgtcctcatacgtatccacttagaagatggacagagaggggtcccatcctcaggtccgtcccttgagcagagaggactgagagaggtctggacctcacatcaatcctcttagaagataaaacgattcgggtcacattctcagtcctgtcccttgagcagagaggactgagagaggtcctgtcctcacatgtatccccttagaagatggactgacagcagtcccaccctcaggcctgtcccctgagctgaggggatggagagaggtcctgtcctcatatttatcccatcagaagatggaccgacaggggtcccaccctcaggcctgtcccctgggctgaggggaccgagcgaggtcctgtcctcatatctatcctcttagaagatgggccgaggtgggtcccaccctcaggcctgtcccctgagttgatgggactgagagaggtcctgttctcttatctatccccttagaagatggcccaacaggggtcccatcctcaggcctgtcccctgagctgagaggaccaacagagttcctgttctcctgtttgctgagtgacatgtatgtggagaggtgtccctttatgaattgctcctgagtagagagtactgagtgaggtcatgtcctaagatctgtcccctgagcagagaggactgagaaaactcctgctccctcattggctttgatcagagaagactgggagagtcgtggccttagctctttcccttagcagtggggactgagttaggtcctgtcttcaggtctgtttcctcagcacagtggattgagagaagtgccatcctcgggcctttcacctgagcagaatgaactaacaggggtcccatcctcgggtctgcccctgagcagagaggactgacaggggtgccgtcctcaggcctgtgccctgtccttctatggatagcaccccggggtctgtggcgggccagcatattttgtacttaattttaggctcatctgagaacctgtcgattcactaccttgtaaggtaagtctatgtcccattgcagttggttgggaatgacaagtccaacctaggggcatggccgggaccccctgctgcttctcccacaggatccagcaccctctgtggcctttctggactcccgacgtccacctgttcctggcctgggatcacctcctcttggtgagctgtgtggcagcttcatttttctgaagatgaagacgccacagagcagtcactttcccagccactcccatggcagggtgccaggaggaaggtcacgccctgggcagtctggctctagatgggctctgggaatgggccctctggctgccagacacaggaacagggcctggcacagaagagtgagacccctgggggccacccttttcccagccctcagtctgtggcaggtcaggtatcactaacacaggcctccacaacaactgcttcagcactgaccgagtggtaaagttaaatattaaaagctgaaagagccagcacccttatacaaaggcttgaatgtaagaaaagcccaccaagagttttgcctagacctttcctgggccttgaaacatgacaaagtaatgaaggaatttttcacaggacccatttaggattcaacacattttattgaaggtctgaagaaactcaccaggcctccacaaacaagctttattggagattaaaggaactctccacacctccatgatttagcaggagacaaaataagggtcatcaccccagcacctggacccatttagattaagtcaatttactgaggctccagagggaggccttccggactcagatcttagttctagattaaaacaagttaatcacttatgtctttttagatgaatgcacacttacatgtagacatatagcttagaagggatataagctctggaaaactttgtaattttgagttggtctggcgatattttccaggttttctctctgtaaccagttatagaaataaaaactctcttcctccccagttcatctgcatctcattattgggccacaagaaatagcagcccgaccctcagtttggtcagggaacaagtcctctcccactgggcaagataatttggaaagagccgaatgtgaccttttctctctcccctttctctttgcctgttcaaatggcaccaccacccaggccccgactccttcacccacagtgggttgtgcaaaggccaaagcagaggcacctgctggctgcttccctgggcctgcagggcagactctggtcccctgctgctgtggtcccctgagccatgggccccagaggctcggctggctctgggcctgggcttacactctgccctctgagcttttccccatccaaagacacccagcatttgggggcagcctctctcaaggctactatcttcctccagaccctatcccctcctcatggagcccagagcagggcctgcctcccacgcctgcagtcctgcacacagtagtcagtcctctgagcactttggcctctagcacctctggctgccctgctcctggccccaggtgcctgctgacaatgttgaacgttactcaagccctgtgatccttgaaaacagcaatggttacaaaatccccccatccctcagtgttccagaaaatgacttattgcaaacaaaaaaacaaacaaaacaacaaaaacactgttatgggtgggctgaattttatttccccccaaaatccatatgctgaagtcctaactccagtacctcagaatgtggccttgtttagagatagtctttaaaaaggtaattaaagttaaatgaaggcattatggtgggccccattacaatatgacaggtgtccctataggaagaagaaatttggacacacagacaaggaagataatgtgaagtaaaacaggaagaagatggccacctacaagcaaaaaagagaggcttggaacagattcttccctcacagccctcagaaggaaccaagcctgttgacaccttggtcttggactcctggcatccaaaactgtgagagaataaatttctgttgtttaagactttcgttttgtagtactttgttatgacaggcctgggaaactaacacaataccccttccccataagacttagttaggactcaggaatgctctccttgtttacctatgacacggacagacacaaaccctccaaattcccatttgcattaatcagagcactccagaaaagcaaaaccagtaggagctgatagatatattattttgggaattggcacacatgattatggaggccaacaaattctatgatatgccatctgcaagctgtagaatagagaaagatggtggaataattcagtccaagttcaaaggcctgagatccaggggagtttatggtgttacttctaatccaaagctaaaggagtggggagcgcggcccattggtgtacaccttggagtctgaaagccttagatccaggagctctgatgtctgaggacaggagaagatagatgtttcagctcaagaagagagagaaagagagaatgagcgagcgagagagagagagagagcgagagaaagaatttgctctccctccatctttttgttctatttggcccctcaaacaactggatgatgccttcctacactggtgagggtgatctttattcattgtactgatagaaatgctatctctcctggaaacaccctcacagacacacccagaaataatgtttttaccagctatctgagcatcccttatcccagtcaagttgacacatacaattaactagcacatccctctacctctcactctgttcttctgttccacttcatggcaaagctcagacttgtctatgcctaccacccacactttctcagctcccatgctctccttgattctctgaaacactggtttcacccattctgctactgaaaggactcaacaaagtgaccaaacaacctcaatcttgatgaatccaaaggtcaattctctgtcctcatcttatttacaccaacatctcagtagattttgacccaggtgactattcttccctcatgaagcactttttccccttggctcctgggataccacatgcttcgggtttcctcctacttcactggcctctcctgatagagttttctgattcctccttctctgcttgattctccgcaggactcagtgccctgggtcctcttctctttactatctacattcacttccttggtgatctcagcctgtccatgctttcattatcattggcaggctgcttctaagcccagttccctcttaagctctaggcttatatgtcaaagtgcctaacccacatctccacttgggcaacagaacatctcaataccaattttcctaacacaaaactctggctcccaagccacaccattcaatcagtgccaaactgctcataagctcacccaagatactggcatcaccatctacccaattgctctgattccaaaactagactcagtttgtcttcttctctttccctcatagattcatattccattatcagcaagtactgcagttctacttccaaatacatgtaaactccatccacttctatctctaccactgccatcattgtccaggccaccgtcactgatacttgcagtgcaatagcctcctctctctctcctcttgctcctctatagtccattctccaaatataactcatagtgatttttaaaaatcagaaatcaaatgacatcatttctttgctcagaagccatggatggcttcccatatcacttagactaaaactcaaacttctaaccatggcctgcaaaccctacatgatctggcccccactctgctgtgtgtttaccaccctctagccccgctggctagtccctcaaacacacctggctcttaatcttatctcagggcctctgcccttactggcccctctacctggaaaacttgtgggaatggaaatattctaggcctgtgctgcccaacagggtagtctctagccatgtgtggttactaggcacttgaaatggagctagtgtgactgagaaactggattttaaaaatgtattttagttgatttctatttaaacacaagtagcctaacgtgggatgtggagaccatatttagcatgtggagaccagagctctagctcgttctgctttataattttacagaacttgtctgaaatcatctattttatgcattcatttagtcaacatttactgagcacctactatgtgcagggcactattataggcactgggaattcagcagtggagcaaaaggacaaaaatctctcatggagatttcatttaagtaaggaaatacaaacaataaaataagaagaaaacatgtagtatgttagattgtgataagtgctacagagaaaaagcaaggaagcaggtataaggagtgttatgggtgtgcacagaattttaaattggatggtccatgaaggtgatcaggaagaaggtagcatctgagcagagatgtgaaggacgcaagggagatggccacgtgggcatctgggagatgagcattccaggcagaagagacaaccagcacacagctcaaggccagagaatgcctggaatggtatgagtaagaaggaaaggtggtgggggctggataaagcagcacctgcttggccagccaccttgaggactctggcttttagtccaagtaaaatgaggcctggggaaggtatggagcagaagagggatgtgatcggattgaaactcttcactcttgcagccatgctggggtacacttcagggtgggaaggaaggaaagatgattgcttaggttattgtaatcatccacatgggggattaggggacaatatgtttatggtgaaggtggggagaaatggtttgcctctggatctgtttggcagggagagttaacaggctaggctgatgggctggaagtgcagtgggagatcagcaggtgatgtgtaggttttggtctatgcaagctgaagaatgggactgccatttacggagctgtggatggcaatgcatagagcatggcttccatggttgagtatgaaatgacaattagactccccaggtggaaatgagctgtgggaagttgaaacacaagtctgaagttcaggaagatgatgtgggctggagcagctgcaattccagaaggaggcagtgtatactgtatctgttgaagcctggaccccagtgatacaacgcagtgagtgcagatagaaaagcgaaggggtctaagaacaaagtcctagagtactccaaagttgagagaatgggatgatgagaaagaaccagcaatggagatagaaaaggagtgaccagtgaggtggaaggaaaggcagaatgggcctagaggcctagcaaagggaatggacctgatatggtttggctctgtgtccccatccaaatctaatcacgaattgtaatccccacacgtcaagggagggagccataattcccacatgttgagagagggaggtgactggataatgggggcagttccccccatgctgttctcgtgatagtgacttctcagagatgtgatggctttataagcgttggcatttcccctgcttgtacttctctctcctgcagccttgtgaagaaggtgcctgcatccccatcaccttctgccatgattgtaagtttcctgaggcctcccagccatgtggaactgtgagtcgattaaacctctttcctttataaattacccagtctcaggtatttctttatagcagtgtgaaaacaaactaatacatgtccactggaccaaacgctgctgctcagtcaatgaggcctgagaagtgtgcatggggtctagcaatgtggtggtcattggggaccttagcactagcatttttagtaccatggtggaggtgagagcctcaaagaagtgggttcaaaagaaaatgaaaaaagagtaaagactttcatgtttatttagcacctgcttcctatcattgaccagaaggacagggtctttgatttgtcactggtgtgtcctcagtgcctactatagtgtgtggcccacagtgggtgctcaggaaatatttaaattattaaatggatgaatgaatgaatgattctttctcatccttcaggtttcagttcagaggtcacctcccccagaataccatccttagccccagaaatccaggtgacacacctctgtgctcctttagctattgcgactgaaataggattgttgctttgtctttctccccatgagatggtcactccacaaattcacagattgtctgtcttgctcattgatgtatccccagtgccccacagaaggcttgatgcactgtacaaggaaagtgagtagccttgaggggtggagctgagtgcaggggaacattaaagagggcctggaagatagcctccttttgtatagcaaactcatactaaagccaaatatcatgtccttgtgaaaagcttctctgttagatgtggtggtatgtgcatctgtagtctcagcaactcaggtggctgagcctggataactgcttgagcccaggagtttgaggttgcagtgagctacgaccatgccactgctctccagcctgggtgacagagtaaaaatctgtctctaaaaacaaaaatgtaaaaaagcttccctgactaagtgttgtgggaagtcagggaccccgaacggagagaccagctggagccgtggcagaggaacacaaattgtgaagatttcattttaacatggacatttatcagttcccaaaattagtactttcataatttcttatgcctgtctttaatctcttaatcctgttatgttcaaaaagaaagggagagatgttgcgggaagtcagagaccctgaacggagggactggctggagccacagcagaggaacataaattgtgaagatttcattttagtatggacatttatcagctcccaaaattaatgcttttataatttcttatgccggtctttactttaatctcttaatcctgttatcttcgtaagctgagaatatacatcaggtccactcagaaccactattgtgttaactgtacaaactgattgtaaaacatgtgtgtttgaacaatatgaaatcagtgcaccttgaaaaagaacagagtaacagcgatttttagggaacaagggaagacaaccataaggtctgactgcctgtggggtcgggcagaatagagccatatttttcttcttgcagagagcctataaacagacgtgtgcaagtagggaagatatcactaaattctcttcctagcaaggaatattaataattaagaccctgggaaaggaatgcattcctggggggggaggtctataaacggccgctctgggagtgtctgtcttatgaggttgagataaggatagaaatacgccctggtctcctgcagtaccctcaggcttactaggattgggaaacccccagccctggtaaatttgaggtcagactggttctctgctcttgaaccctgttttctgttaagatgtttatcaagacaatacatgcacagctgaacatagacccctatcaggagttctgattttgtccttgctctgtttcctcagaagcatgtgatctttgttctgctttttgccccttaaagcatgtgacctactccccatttgtacaccccctccccttttgaaatccttagtaaaaacttactagttttgtggctcaggtgggcatcacagtcctaccaatatgtgatgtcacccccggaggcccagctataaaattcctctctttgtactctttctatttctcagctggctgacatttatggaaaacagaaagaacttacgttgaaatattgggggcgggttcccccgataaccaagcagcccagagtaggtcactatattatagcatataggtcaaggctgcagtgagggccttgaccctgtctccaaaacataccctgtatgttttgttcagagcacttatcacaacagtattttgttgtgggatgtttgatttactcctctcctcttacactgtgagctccacagaaatacaaactgtgtctactttactggggcccccacgtctggcacatgggtagacatccaatcaatgcttgttgagtgattaagtgaccaactggaacatcaaggtgctgatcaaaagaaggcatcgatgggcagaagacatttgtgggaggagatactgaagcagggggatctgccaagggcactacaggcagaggacatgataaggaggtgatctggcagccaagcattatgcatgccacgttgcagcaagctcacaactggacagctagcacaatgcggagcacagtgtacagtgggcctcagaaatgaagagcaatgtgcagcagactttcagagagagggagaggcagttctcaagcagggtgcattattcagagaggctgtgaaggcagagggcagagtggacagtggtcacaggcagtgaccgcagctgtgcagggagaaccccatgaagaacacattcacagcaaagcacagggctataaaacaagcctgcacaaattttaaaatgttgaagttatgcaaagtgtgttaacctaccataatggaatgaaattagaaactgataactgaaggaaatttggggaacccacattaaacaacaaactccaaaataaccagtggatcaaataagaagtgataaggggaattagaaaacctttgagatgaatgaaaaggaaaacacaacatgcagctagagaagtgctcacagaacaatttccagctgtacatgcatacattcaagaagaaagatattggccgggcatggtggctcacacttgtaatcctagcactttgggaggtcaaggtgggaagactcattgagcccaggagttctagaccagcctgggcaacatggccaaaccccacctctacaaaaaaattcaaaggaaaaaattagccaggcatggtggcacgtgcctgtagtcccagctactcaggaggtttaagtggcaggattgcctgtgcccaggaggtcaaggctacagtgagccatgactgtgccactgcacaccagcctgggaacagggtaacaccctgtctcaaaaaaaaaaaaaaaaaaaaaaaagaaagaaggatctccaatcaataacctaactttacaacttaaaggaactagaaaaagaagagcaaagtaaatccaaagcaagtagaagggaagaaatgacaaagattaaaggtgacattaatgaaacagagagcagaaaataatagaaaaaaatcaataaaatgatttttttttaaaaaagtcaatgatgtggttctttacaaacaagaaaatcaacagaccttaagtaagactaactaagcaaagcacactatggcaagggcaattacaggcagaagcccttgtgcagataggcctcattggctgggccctaggtgatgaacaaactcagcagcagagatcagagagcagaaggcatctgcaggtagaaggcactgtgcaaggagccaggagcagaaggcattaggaggcagaggacagtgggaagaaggcattcagaagcaggtttgggaccttcacaggcagaggatactgtacagagaagtttcacaagaggaatacattctggggaggaaaatccacaggccaaacacaatcctaagcaaggagcagtccccagaggacatagagatgcatgggtaggagaccgtcacagatacaaacctgggatagaaaggaggagtcatggtaatggaggaggcccaacaataggatcgacttgctgtttcagaatgaccctcccctatttttcctttaggtctttgtgtcacactgtcaccaattaaaagtcctacaaatacctagttaggagctactgttgcagtccttgtcatttgaattagtaaaagctcttccttccttcccattgtaacaagatgaaggccaaagttggggtgagaaaatagctagagggacactagtccaatggccctgaggcccctactcagtggcagaaggagttctcggagtattatgtctatctttggacttcctgatcaccctttcctgtccctgggttgaatcaagacttggatcgcatgcagattacactggtacacatctagaggaatgagttggagtatgtgttggggtcacctttgaggagggcctttgagagatgtgtattcagaattactgtcaaggaagagttagagggaccaggggtgtttaaatgtgagaagagttgaccaagacagaatctgagaagtattttcatctattttaagagctggcatctagcggagggattaaagaccaccagtgggtgacatacagaaatggactttaactcaactgaagaatgcatcttctaaaaccacagacagcaggggcttgtaaggaactgagctcctggtcactggaagtgggcactaatgactaggtggctgtctgtctgcagtggtaatcatgagaaggatggaccgcccccgctctctgccgccacaatacaatattcttcattaagatttgatgtgtctagaattccacagttcctgtgcatgcccagtgtctagagcttgctattaagtacttgtttacttttgtacagagaatggcttcaggcaataggaataaagaaatcacacagctgaatacaccaagttattacacttcaaaagaaaactttaacactgacacatgtgatatcttaccatttattataattgcgcacattagtgtggattaagtatgattagaaacactaagcaattgaaaagaagcaaaaaggtaatgcatccctcttcctcagatctgcaaaattctgtgcctttttagacatgagagaggctgttttggatctaagtcaataatggctcttgcaagatttctttcaatgtcttgcatgttggttctaaaactcccttaaaggcagactataccttgaacgggggaagccagcctatcttgggcctctttaccttgcctttcatccactggtcctgcactgagactcagggatagcacctctcaccaacggggtgacttttatttccttcactcattcattgagtgcctgtgtgttagtgtccaccacgtgccaagtctgatgttggggactacagctgaggaagagcagttggtatttagtgtgggtacatgccctccagaggaaatccactacaaataaatggaatgttcctctctgatcatttggcaggaagaacaagcccacaagccaatgtgcatagggctcagaaactggagaaagacgtagacattttataattaaatcaagagcagaggccctcattttgtatcagaaatactctaaggttgttcttcctttcaaggaacttacagagtgatgctgggcccacagatggcagagtccagctgaacctgagcagaggatcggctgactgcatggacaggcttacatctgcccagccatccaacgagtttccatgtcccaagtacctggggccccagcagttgccactagcttaaggcagagtctagacaggaaaatgggtcactgaaagctctctgctcagatcagctagccccctggagcttttcctggattcacaagctcctctttggtaatgtctgtgagtcaaatctgttctcagctgaaagcatctcagtttggaggcattttcatgggcggagaggagggaaaggggcagcttggcccttgaagtacttcatggggggggggataattcagggatccaggatgcccagaggaagagtgtgatttcacaccttctgctctttgcaagcctatgcctttgggaggcctgaagggagggtgttaacctggcaggaactgtgtaccctctgcacagtgcttggcacacactgagcacaaaatcaatgcttgcttttgtgggtgctgctctgggaagagcatgggctctgtagcgttctgcgcaatgcaatagccacctctctgagttccaatatcctcatgtctaagatgggatgagaatatcaccttcacaggattattatggggattaatgccattactctgtgacagtgcctgctatgtggtagagcctcaagaaatgttagctgcttttccacctccttaatcctgctgggatctatacaccctaaaacccacttgggaagatttatgtgtgaagttcagggagcagaattgagggcaaattaatcagctatcaagattccaacagacacagatatcactttgatcagtagcatcctaaaatcacatcctactgaatttaaacctaattgtgtaaattttccaacacatgccaacatacctgtaagggaacactcaaatatagtgaaaggtgagtggaagaccaaatgaaaaactgctatataactcaatcaaaagcaactaactacttttacaagtgtatggaaatttaaaaaaaatagatatggcaaatagacaagctaaacactagcctatgccaatccctagcatttgatgtctgcaatttacccaccagggatcatcaacagtcttcaacttggcccattataagcctcaagggagtcaggacacactgaaccctacacttctgcccacttaaactcattagaaagccaatctgtcttagggaagccaagatggaattcctgtttgatcctctttggttgagcctgaaatgacatcatgggcataaagcgctttctaagctacaagaagctacacacacaagcaattatcatagcatcattaagatacgatattggatgtatgcaacttcaacttgagaagggcaaaagcatgaagaaatcaaacagggagggaggaggtgagggaaggggagacagcaacttggggcaaaactggggacagccaaatttgtccacgagtcatcagcttctgatcagcctggcggtggggggtcgctaaaagaaaacagaagtagccatgagactggaaacacatcagctagaggccctcagggtgggtgactgctccagtcatcaggagttaccacctagctcaaggtgtgtcttctggagagaagaccatcagcatggagctagtggaaagcctggttgctactgccttcaagggatatattctgctctgtgctcagacaccgtgataaattccactggctatgagcatgcaaacacacatcttcaggcagttctcataatgtggcccagaggcttgtttcactgagcaccatggctatgcagtcctgatctgaagctatgcgagtgacagtgaacagagagccctggacaagaatccaaagacctggggtgaggtcctgattctacctgggtttctccaggtcccctccctttctatatctttatttccttgttgcaaaatggggctaacaacagcggccgagcgagtatcccagggtagctagagggctcggctcaggtgctggacggaaggtgtgatttggaagtgtcctcattgagggcctttgtccatgccacctaagatctcaaagtatcacaaggcatagggacatgaggacacaaggccccctgaacataaggaagagccaagaaagatagctgtgtctggggctgagactccaggagagaccagggtgcatctctactccttaatgagtctcttggccacttgtcctttgcagtgccagcacccacctagaagagcttctcatagcatttcccacagtgaatggtgtcacggtgaatgaagatctgatccaggagatcgcccatcggtttactgcaaatcccacactgaaaagaaaagcaagctggaggtcaacacacaaagcaaagcaagaggaatgagtggagtgggaaggggatgcctgaacaaggtgggcgagcagatgctgtgagcccgtggcacatcctggacctcaggacttgcaaacatcacaaaataatacaaaaaacatcacaaaataatacaaaaaaaagccttttttttcagtagggagtagtaagcacagctagcagctcagctactttcaagggccagtgggcaagcaaaggggaacctgtttggcatgatttgaccagaaatgtgtttccctgtggtcagccggttctcaggagaagctgctaagtggggcatgttctgcattgcagcacttacttaaccaggagcaagcaaagttcaggccctgtggggaggacagaagcctgcctaacattctgtcaaggcaaaggggagggttgtttttctcagtgcacccagaggtgacaccctaaatggattggaaccaacaacctggggttacaaagtgccacacactgtggagaatggggaccccaatgtcacttagaataaaatccaaactctgtgcccgccaaggcctacatgatctagcccactctgtcactcctggcattctcccacgcaagctagaacactctagtgcttctgccccagggcttttgcacttgctggccctctgccagaaatagtctttcctgaaaagacctcttttgtcttccctacagtactaagcatgcagaaccaccaacactcatctactgtcttagacttggaagctcattcagctcccagttgtgcaaagcctctgcgactatgtgcaattgtatatggagatcaagcctcctccacagtctctgaacccgtaagactcccgcactctacaaaacgttcttagcagcacgtgatcaggagttaccgcctagctcaaggtgtcttccacctcttttttaccttaaagcaatattcatggcagcagataccaagatgttctagggtaatctttggacagtctcggatctcacggttgcagtaagtacagatccctccagttgtcctgtgagatgaagaacaataacccggtggtcaggctggtgtacagacctctgatgtgacacagccagaccttccaatttggtgcagccaggcccaggtttgctgtcaggatccccaggatgccactgttttctgtggtgtgcagcacagccctgggccagatcagttctcagcctgctgtagacctctgcattatttccaaaaactagtcatgcatctttttccagctcacaatgacatgtctcctgtagatgtcctgatatgatacttattccagacagtttgcctccccctgaccttctgcttagattatccgctggggcctgctaccctctagagcaggaagaccaatgccttctcctacaggagacatgtcattgtgtgccctgcctggccccgtcttgatggcccttctcctcacgcctgggccaactgagctctgcccctgcctatactcctggacccacccttcatgctctgtctgtagagcctactcagatccgacactgaagttctagatactgactcctgggttgagcatctttccagttccaggatgcctgtttctgagagtcacctctgcttttcttcctcagactgcacttcctcaaagtaactgcttgatctgatcctacaagccaaaattcagggtactttcttccagagatttgggtctgcttctgacagaagcccaaggggcggggggacattaacaatctagatccacgttagctctgtcggaggacccagaagtgtcacgggcagcttgggtgtggcccaccatcctgctgctggcccagggttcactctggacagcagtgctgcttgaaatccttgccctcagcgcagccctgctcctcctgcttctttcaccaccagcagcaccagctcacagctgttctttgtgtgcgtgcatgtgtgtctgtgcatatgcatgtgtgcaagtgactgagattgtccctagagagtccccttccttcctccaagcctagcaatggatcagtaatgactgattctggatttagtagttgtgcaatggaaaggggggtccctagagtatctggtttgtcactccactagaattggaagcctcattccatttgctcctatgtaagtggttaactctcaggtttctgaccaacctgcccttctctgctaagacttcatctgctgatgtgcctcaccaagtaatctgtagttactcagaaccacctgcttcttcagctatagtggaggagattccctggccccatatgcttgtctgctcctatatgtttgcctctggggcccggtaggattctctttatcttaaccctcttacttccttccttttcctccccaatgtagctttggtctctgaatgtcatccacatgaattaagatctgcccatcaatgagaagcaagatggcagagtagaaacatccctaacctgggagtagtcagggccctggggtttagtcctgggtctgccgtatttgcttactgtggactgaaggctatttattccattttcttcacagaagcctgagtgaactcaatctctgagactctcttctccccattccaagaatctgaacataagatttctttgtcattaagactctctagtgactgtgccatcatctagtgacagctttcaaaactgctgaacgaggtgttctctgcccctgctttcaatttggtggctccacagcactgggcattcttggctttgtgtgtctttctggcttcttgatgccagcagcccatttttcttccttctctgcccactcctctcttttgtagtcattttatttttacttctggttagatttgcaagttaatgaagtgattgattaggttctaatctgaagggcccctcctgctgacacgagtcctctgggttgtcagatgccaccacttcccttctcagtcaccgctggtatctaccctctagtcttagctcaattcaaaggctttagttgtcacaagtgtgatatcccaacaagggaagcaccaccctacggtagtgtccttcacctttctgcaaatggattggaggctgcaaagcagaagacaaaagcaaacagactcagcaggaactctcccttccctgattctcctctgtagaagtgcaagctccgtgctaagaaagtcaacatacctctcagagtatggagtgctgccacatggaggcttcttctccatggcgaatgagtcctcaatgctgctgacgctgcagggagtttgataggggagaggagggcagagatgagagccaaatcactatcatagttaattttctaattaacctttggccacaagctgagacataactacgatgccagtcgtcattcatgacttggtgccacagggcccttctatgggggggcaaaggagacctttcacaatgagggagatgatcggggctgggtggctaggattcctgaggttgtatatgccaaggggaccccactgaccagtgggaaaacagcagagctttcctccccacctatgatataatgtgacagtcaccaggagcccactcagcagaaatcagatactgggaatgagaagaaagaagggatcattctggtataatacctgtgcttgagttatggggtagaattagggggtgcagacgggtttggagtttctttttggggagacaaaggtgttccagaattggataatgatgtttgcataactctgtgaatgtaccaaaacctcgggactgtacactttaaagggtgaattataactcaataagctgttgagaaaaaccaccctaagggcctacagatgtgaaagcaaagctcagagaggttgaacatcttgtccgaagtgatcctaacaggggggcctgagctggggcttgaacttgacccccacagccatgctcatcattccacagcaccaataaaagccagtccagaagccccagaggcccaatcctgaaataaggccaggatgctcctctctgttgctaaaatcctccagtgagatgacatgtcataagaaacattctaagggacctcacctcagtgtggtaggtagcaatacaccgaggtgacatggaagtacccctccacatggcatcacaaagcaagaaaatgaagagatgatcaatgaaaaggggaggccgaggcaggtggattgcttgaggtcaggaattcgagaccagcctggccaacatggtgaaacttcatctctactaaaatacaaaaactagctgggcatggtggtgggcgcctgtaatcccagctactagggaggctaaggcaggagaattgcctgaacccaggaggcagaggttgtggtgagctgagatggcgccactgcactccagcctgggcaacagagcaagactccatctcaaaaaaaaattaattaaaattaattaactaattaattaaaattaaaaagcaaagccacacatgtatcaggaactgcagtcacatgtgtgttcaaatgaggcagcctggcatgacagaaaagaacatgagggcagaagagaagagctctgtgatctgaaaagaaataggatgagctagttggtccctagggctctgccagctctgtcaagaggggtgttctcagcattttacaaaataaaataacaaagacaagcagaacagaatggcagtgaaaatggtgtgcaggatgaattcaccggaagggagaacccaaaggtgcccagttcagtagaaaatgcatcaatcccatcagagggcaactacatcactcatccactcgacaattaccccgaagctactctgagccaagtcctggacaaggaactggaaatgcagggatgagaatatgggagccggcaggagaaggccgacatggaagggtttgggacccgctcttacttgctatagcgtgcagatactggcttcccagaagacacttcactagcattcacgtactccttcacgaagagaatccctttgctgtagaaggagcacagaagaaatcagaggtacaccagaagattccagggaaccaggcctggcccacaggagtggttcagggctggggagacccagcctggtttgaaggaagtgaaagagctcatgggaaggcccaggataaaggcactggcactgctgtggactcagactacaatcccaggccatgagcgtctcttgttgtgtttggactgagggccccagaaaggggcttcctgcaaccaatgacaatgtgctgtcctcctccatgcagacctcggtgaccccatcttctccccaggcttctatacttctacacttcagtcctgtgggctttccacccctactttagggctgcgtcgtctttcccctctacccacaaccaagatatcctccaagccttaatcctacactgtcagtctttaccactcagcacttcccagaaggtactcagctactgtgcaatctccacctcacatctaacctctccattctcactcctagagtccagaggcctagaggttgcctcatcctggactggcctctgcaggactggaaacaaggtctgcatcatgctgggctcaggatggccccaaattttcccccatttccatgctgcacactccagcctgctgacctgatgtctgcagaggcccccttggatatgcccccctcccgcccccaacacacacacctcactgagcagccttcctgcagtgacatcccttcctgcaccctgacaggtggccaggaatgcaggtgaagcagtgggcatgtgacagagacagacaaacctcatgttgaaatgtgattcccagtgttggaggtggggcttggagggaggtgacgggatcatggggggatccctcatgaacagctagcaccatccccttagtgaaaagtgagttctcattcagttagttcacacaagatctggttgtttcaaagtccgggccctccccttcctcactcttgttcctgctcgtgccatgtgatggtcctgctcccacttcggcttccaccatgattataagcttcccgaggcctttgccagaagccaagcagctgctggtgccatgcttgtgcagcctgccaaactgtgagccaattaaacctctttcctttataaatgtcccagcctcaggtattcctttacagtaacacaggaatgccctcacaggcccggccttcacggactggagctggcttcccaggcatggacccatgaatggcagagccacatccactagtgcactaggaagtaccactgcagcctcttacagagataggaaaaaggaggtgtgggaatgtctaggcccggtagatgggagtttatattaggggactaacactgtcctgtgtggccccttggctaatggcctgctagaaactggggaaggcactaaatgggaagcaacatggaacaaaagccaagtcctttaccgccaaggaggaagtggcggaggaacatctcccaggttgctagatagcccttcttacgtggtagagctggagtccaattcacttgcgggggctggaatataaatgtgaggctgctcagatgtggcagtgacagtaacagtgaccatgcagctcgaggggctcctcaccctgaaagaaataaagggaggggtgggcacgtcaacctgggagctgacaccttccagggtcaaacaggcttttctgagcctaacccttgagcactgctcttgaagcttcctccaagaccaacaaatggaacttctcactttacagataagcaaacccaggctaggtgagttgagacatgtcccaggtcacatcgtgagtcagtagcaagaccccaatcttccagtgtccactcagtactcctgactgcagccaagggccttggcctctgtgattcactcagttagagtggaatcatggggctcccggggatgtgacagtcaggagggtgcagaaggggaagacacagcccagctcacctcctcactggatgggacggtcccttactaggatcagctccttctgccaccctgcagggaactctctagagaacacaaggccaaggggcagaggaccaaatgaaattaggcatcattgaggaggaaagtcagatgcacctcattcccagcagaggcgggaaactgaccggtgtcgaagtttttctgaacctccacacttcagctgccagatatggcccttggcctggaatccaacctcctcggcagcccaaaagggcttttctctggccaagccaatatcggctctcactctgcctgcccccaggctatgagcctcattaccaaagctgccgtagctgtcaactgcagttcagggcacgatgttgggcagcaccactgaccacttgtttgcaccttccaacttaagtctgctcaccctccaaaggcctgaggccagcactatgggtgcacactgccctgggctgattctggcttttctccaacatgctgtggctcagatcatactccagatatggctgcctccatctggcccaggctactgggtattgtccccttgccagagaatccaatgcctaagattacaactagttgaagagtggggaaagggaagaacaatcatggtctagcatctgcctagctctctcgcctcatagtctcaaactgtatcacgtgccactcaagccgtacagaccagcctgcagttcccctggacttccaggctctcatatgcctttgcagacaatatcacctcctctgggaagcccttcctgagggcctgccctcctacctcacctcagtgtacccaatcatcctgtacctgttcctgcttcaccctatgacaaagaaatataccatagagactggagaaggtggactggatgggagaggaggccccacaaaaatctgaaaagatacacgggggataaaatgcagagccaacaagtgagaaaaggattgattctaagaggaaggaaggaagacctcctactgactgaacaactaccaggtgtctggtatcctgtgatccatgtcagcagaatactgaaggggacggcgcaactgaagaggcaaggtaaaacagaaattccctggagctacttgggaagctgaggcaggaagatcacttgaggccaggaattcaaaaacaacctgggtaacacagtgaaacaccgcctcttaaaaaaaagaaaaaatgccctgggcatccccccaggactgcaatgtgagcaataggagccctcccaatagcctcctctccctcacctacaagaccctacagggcccagctcctgccccctgctcacctcaccccgtaccctccaagcacagggctcattgttcaggccctcctccctatcttctttgtccacaatgcctctccccaggttctttggaaggcaggctcctccagatgtttcaggtctcagccgaactgtctcctcctcgatagaaaagctttccctaaccatccttgctctaacccctctccatcagagcacctggtttctttccttcctgggcttatcacaaatggaggggcagtatggatgccacagcgatgaacagtacaggctctgatctctgtctggattctaatctcggttaggccacttcctggctgcaaaactgccagcaaattacttaacctccatctgcctcagtttctccataataaaagcacctccttgagttggtgtgagaattaaatgagtgagtccacataaggcatgcagaacagtgcctgcacattctcagcacacagcaggtgctaatggttattacgatcatgcttattccttagtggactatgtgctctttgagggcggctggatggggccttagccatcgtgttcactgtgtacatggctgctcacaggaggctcttagtatgcagcatctctagccggcggcccatggctcctggttattcccaaactcatggccactttgggaaaaaaaaatctctggggaacaaagggagctctcaaaagacacgtgcaccttctttcaccatcatcaactgcagctccaggcagtgataaagcaaggacctctggcctcacacagaaaaggaccagagggaaactgaggctggctgctggcatgcatcccatgtgttaggtttgagagaccagagccaggctgaggaatgcaagaggtcagcaaaaattttctttgctgagttccttggcaagataaagctagcacagccctctcctcaccctgttcctgaagccaccctatcaaagcaatggatcatggcaggagagtgaaggcagagccagaatacttcattggcagggacaagatgaggaaagactggaagctggtcaagggaatgacctggaactgggagacagagagagcacagagatcacagcaaggcaatgggtcaaaatcagttaagtggacaggacgatcgccacaaaataccagaaataaggacatcttgaaaatgcagccagtcctgcctcgaactggaagcctctaccacatgtcctgccagtgcaagagccaataggtgggttcccagtgaccaaagctggatgtgagagccagaaaattctgtcacagagagggagatgaagttcacctggcaggaatgggtaaaatgtcatcaaatcatggcattctctcctgccctctaggccctgcccatgttgcaatggctgtgaagcacttcctgagaccacactgtttccagttcaacaactccagttttccatggatttttggaaatgacaattgacagaatgtttcaggatgatataaaatctgatactagattgcctgtaaaaacattttcaaaactcaattattttcaaatgtgaaaaaatatgctacaagtcacctaggatttcaaaattgggaaagttcttacagctaccacaaacatcacaattgggtgtggatccacactgatctacaaaggccagaagccaggaaactaccactttgggagacctgagctgctcacagaaaagcacaagcatctggtgttgtctgttccctagtacctggctgttccttggttcttggtctctctcagaaaattcagagcccctgtttcctcaggctactgctgccaacttcttgcaatcaatgagcaaccctgagtcagcactgtggagctacattactgtccaaatccatggccatcccagtgctgatggcagtggaagagctcatccaactggtacagttgttatttctggcagtgaatcacatccacaccatggcacaccttgctcagagagtttccatctccattaacagaaaaagcaacctatatccctcccctgacccaggtttccaggttcgaactggctgccagacaacctggttctctgtgcatcctttctgtgccagacttagtctaacagatttgatgctatggctccaagctgaaacccatgaatatctacccctgagatgctggtttctctccttccctctggctcctaaccacactcacctgcagaggataaacaggcatgcctagtgtgtgggggtttgtcctgggttgctgccctggacaaaaacactggctctagcaggtaaggtcccagtgcagtttggctcgtacctgctggtgcagctctctcgtctgacgaattgctcagatccgctggggctgttctgctgttctggggtactgggatctgcaggttgctgagtgggtacagctgggtctccttggccacctcttggggctccaggcctgtcctgccaggcctctccgaccttggtggccacatccttcccctcaaaatcagtcaacacgctgaggaagaataagacccttatgaagtgagtgccctgagactagactttgttctcccatggcaggtaggctggctgtcatgtctcgtggacttggagggactcatctccccaagagtggggcagacaggaaggaggcacaatccccaccccaaggagcagtcagtctcctcctcagtaggacccccgcagtgctgctcctttctgacaagggcaaagtcacctgacgacttcaatgaggtgttaaaagacatcgtcttctggctggaaacacactggtattcttgtccccatcctcccactgccatctctcctttctccagttctttcccgcctccggcctctctaggaagacctaagccattcagccttcttccctgaccatggtgctcaagacctgtgcgctggccaggctcatcaaatacccggcagtctagggaggagcttctcccccaagctaccctggagggctcggtaggggcaagggtaggggagtgcgcacgtgttggtcaccagattcccaaatccgctgttgaccccacaaaggggggaagggccaggagaatccaaaatttcttaggcggggccattatgagaaccctagacccatttgtgatcctcgagcgccatctggcggcaggaaccgggactgctgcagaaaaagcctctccacggtcgatctcgcccaaaacaaccattttctttgttgatcgtctcatttcccggcgagcaccgcaggcagagtctgcggctgcaggaaatggcggcacgcgcaggcgtactcacgccggccgcaccccggcctgtgcacgcacgatctcagcgcgcgtgcgtgcacccgcccacttatcgttgtgaccgcgtagttttcacatgtggaaccttcttgtcttctttattggaagtagtcatagctattcctggaaagcaatagcattttcatcccctgcccccctttttttttttttgagacggagtttcggtctgtcgcccaggctggagtgcagtggtgtgatctcgactcactgcaacctccgcctcccgggttccagagattctgggactacaggcgcccgctgccacgcgtggctaattctttgtattttagtagagacggggcttcaccttgttggccaggctggttgtgaactcctgaactcaggcaatccgcccgcctcggcctctcaaactgctgggattacaggcgtgagccaccgtgcctggccatccctttttttttacagatgaaaaagttgacataagggtccaatttgcaactaatagtagtcaaaatggaacttccttgttcctgctgcagttcaacctgatcaggtgactcctgctacatacacttttagcgtctctaaacttagttcctcccacctaaccccagctgcttctcttccccttccagcagccaaactccttagaaagagctgtctacgctcactcttgtcaccttttccttcctttcttaccatcaacattccatggaacctattaattgcttctggaaaactgagttccttctgggttacacattacgcccgggaggcagcaaattcttacagaaatggtgacatcttacgaaagataacttacagtggaacattccaaatgaacaacaacacactgaagtgcattttaaaaaaaaattcttttgtgttgtggcttggctcccggggcaatggtgcagagagccagatcaccagggccactcagggaaagggagcccagaagcctggcatgccagcaaaagggtaaatatctcttcccagtcagatttcaggcttctctctctctgtgcaaactgattgtaaaatcactgtttatctcctctgtaaaattttaattaatgcaaaaaggaattctgaggctgtctagtcttaagctgtagtcaatctggtatattttgtgctataaagtcgtttttctgtgtcgaggggtaccttaggataaaacatgggcttgggcccccataagcttgctgctcaagatggcccagcaagctggtcagtgacaaactttgctgcaggtccctgaaaccaacaaaaaactggacaaggtcgccatcctgttttatgtccttgggagcttgaccttgtaaccatgtggcagtactttctccttgtctctaccttccagggaacaggaattttagggttcatatcatagttagttctaaaaattatcttgactagttaaaagcctttgcaagctcaaaattaactactctagactccttctgggctcagtagttaaggttttgccctttcacagtggcagtctgggttcgattcctggcttaggaaataagtcctttctggtttaatatctgcatgaccttgtctatacctttctcctccatggactgtcttaaattttcctttgagcacctgggagttcgagaccagcctggccaacatgatgaaaccccctctctactaacatacaaaaaaaaaaaaatagccagacatggtggcacacgcctgtagtcccagctgctccagaggctgaggcaggagaactgcttgaactggggagacagaggttgcagtgagccgagatcatgccactgtcagcctaggcgacagaacaagactccgtctcaaaaaaaaaaaaaaaattaaccttgtaaaaaattttatgtatgataatactaaatttaaaagggtattattaggtttttccataaattgaacatggacataaaagcacaacaggttttcttagagcactaatctgctcttcaacaaaaattgtaaagggttataaaaggtttataaaattcttaccttatgttcaaactgattaagattgaatacatttgtctataaggttttatttaagaattgggtttgacatcgataatgcactaatgcaacagtgacatttggcttatttggtataaaaatcatgggaggcattgtcaaaataaaaatactgttttgttttgttttgagactgagttttgccctcgttgcccaggctggagtgcaatggcatgatctctgctcactgcaacctccacctcctgggttcaggcgattctccagtcttagcctcccgagtagctgggattacaggtgcatgccaccatgcctggctaatttttctatttttagtggagacagggtttcaccatgttggccaggctgctcttgaactcctgacctcaggttatccgcctgcctcggcctccgagagtgctgggattacaggtgtaagccaccgcgcttggccaataaaaataatgtttaatcttcagggtatatttttagtgaattatattaatatatattccaaaattatatggggtttctaaaattctaatatgtatatcaagtgcagattataaaaattcagtcatacaggattaatgaaaagatcacttagtgaagtgagtagactcttcgtctagctcattctttattttatttaatttaggcagtttgttttatggggacctcaggtaaacagcatacttcaaactctgggtattatcctactggtagtcatagtagtctccccagtgcactgtattctctcaaaggtttcaaatgtttgcatgcagccatctctgaaatgtcaaatggtctctcttcaactggaataacaaaactgattgaaatgtatgattatgaggacatcataacctatgaatgacatgctgagactggaaacctaaaatgatggtaactaggtaactaaaagtggtgctaaggccctaagttttggtcacactctcacctaagtgagaacctggccaataaggggaaatattttttttttttttttttaggtggagtctcgctctgtcaccaggctggagtgcagtggcgtgatcttggctcactgcaacctctgactgccaggttcaagtgattctcttgcctcagcctcccgagtagctgggattacaggcgcatgccaccgcgcccggctaatttttgtatttttagtagagacagggtttcaccatgttggccatgatggtctcgatctcctgagctcgtgatctgcccgcctcagcctccctaagtgctgggattacaggcatgagccaccacgcccagccaaggggaattttttaaacaaaattctggcaagccattgttgtgtactgagctcatgcactaggacccaacagaccaaaccaaacaaaatggagttgctcatgctaaatgtaacataatcaaactaagactttaaggaaacaaatagttattaaaacagaccaggttttgtttttgtcctgtaaacagaacattctagcataaagaggtaccttctactcagtccttattctctccttacaaaacccactgtcctcctgtttcccagtgggtttcaagaccatataagtacatttacaagggtaatagtgatatcaataactaaggtttttgtcaatctctcaaagttgagaaaatgaccaaaaagggggaattgttaaagcaaattaaatacggcctgagaaggactccatagttctatatttgagtctttgtcaataaactgtaacctagaggcagacaaaattgaaaacctaacttaggagtgtgtacctgtaacaatagctaactcttggccaatcccagcggccatacttcaaccattcatacactggtgagtgttcaaactgtgttcaaataaggcatacccccaacctgtaaccaatccagccgttctgtacctcacttccaatttctgtacgtcatttccccccctccaccttttttttaatctataaatcttccaccatgtagctgcactggagtctctgtgaatctgctgtgattctgggggctgcccgattcacaaatagttcattgctcaatgaaactcctttaaatttaatccggctgaggtttttcttttatcaccatgtacctgcgtcctgcacctcacctcttacatgtctcataggtgttacatttaacatgcccccaaacatttcttctacctcgctggttgagagtctgagtcaatgaggtgataacagttttttgagatgaacaacacagggggagatacagaattagtacattagttaatttgttttatttggttgtttttggtgagaagctgtgttgataaagatggtttgggacatgctgagttttggaaggtggcagaagtccataaggctacctcacggaactacatataggtgagcctgctgctcctaccagttgtttccccttgtttctcaagagtcttaagccagaaacccagaatggattattgcctgaaggatgatcaagtgttcacagctgtctgctttttaccctctcctttgccttgacagaatgttaggcaggcttctgtcctccccacagggcctgaattttgcttgctcctggttaagtaagtgctgcaatgcagaacatgccccacttagcagcttctcctgagaaccggctgaccacagggaaacacatttctggtcaaatcatgccaaacaggttcccctttgcttgcccactggcccttgaaagtagctgagctgctagctgtgcttactactccctactgaaaaaaaaaggcttttttttttttattattttgtgatgttttttgtattattttgtgatgtttgcaagtcctgaggttgcagcattgtccctattgcaatagtctttttaaataaagtattggtcgggcacggtggctcacacctgtaatcccagcactttgagaggccaaggcgggtgaatcacttggggtcaggagttcaagaccagcctggccagcatggcgaaaccccatctctattaaaaattgaaaaattagctgggcatggtggcgcacgcctgtaattccagctactcagaaggctgaggcgggagaattgcttaaacccgggaggtggtggttgcagtgagctgagatggcacctacactccagcctgggtgacagagaaaggctctgtctcaaaaataataaaataaaataaaataaaagtctctatctaaatccatatttgttttttgtttttgagacagggtctcgctctgtcacccaagctggagtgcagtggtgcaataatagttcactgcagcctcaactcctgggctcaagcaatcctccactacttcagcctcccaggtagctgggactataggcacacaccaccatgcctggctaatttttaaaatttttatagatataggagtctcgctatgttacccaggctggtctcgaacccttgggctcaagtgatcttcctccctcagcttctcaagtgctgggattacaggtgtgagccattgcaccctgcccagagacggtatttgcttttattggacactttttatggttctgtgattcagttactttgattctgttaaatgagctcttcccagttcttttctgtttgagcaagaatcttcgcagacagaactcttcctagctctttttgagtggggatttaacccctgactctgttgagcaggactcttcctggtccttttcaattttagccagaatcgtcctggatagaagttttcttggttccttttgagtggagatttactccaaattcctggctcttttgtgaggcctcattgtttcccttgacaccttgtctagagattgcacaaggaaagcccttcagctcctcaatgaggactgaagagaaactttggctcccagatgacgactgtgtgcagaacttcctaatgagactgtccagcctggctcctttctctatttgatctgcctcttcccacaggtaactctcaatctactgggtgcccttcctcctcctcatcctcctcctcctcccttgctgactacatgccctgcccctatggcactcattctgtccagtatttccaaaactggcaaaaaaaaaaaaaaaaagtaatcacgaagggtaatttggaacttcagtgaccttattagggaacctggggtctccccaaacctgctcatctaagattcccccttctcatcttcctaccgcatccctcttcccttcttttcaccaccttggaccttcccttcagctccctgaatcttttcatctgtccccttcaatgcctctacctcctacatacccctatctactcttcaccaggctttccccttcccactcagccctctcaactgcctatagccagtagagcttcaggccccctgcacccattgagggctcgccattagatctctatttgtgtctgtctgtatgtttagtatacatgtatgttgtatatgtgtaatagttcagtacctccagatggcattaccaaattaatttacaaaatcccttatcctctattctaattgacttagagataaataagtacttatataaattattataaagctctcataaattaaggaaacaacttctaatactttcagtgtaaacaacaaaaaagtattcttataaaaactaacccaaatgcttttaaaactcaagttcacagaatttatgtaaacttttggcaaacaaaactagtttaatattgttagtttaatagacacctatgtgtctttgagttatcagcattacatataatacaacagaatacaagcatatatttttactctacttgggtatgttcctcctaaacttaaacaggtttacatgttgaataagctagtattatatctactacatgtttaagattataaaaatttaaatttgcttttaaccaaactgagtcattattctggcaaactttatttcaacagtaattatgttttataatatgtaagcttaaaggcagtttctaaaatctttttggtaacttaaaaccttagacttatgctgaattaagttaactaaattcattaaatatcatttataaagaagataaaatacttagtcactagacctaaatttaagtttatatactttttgctttttttatggtacagtgtgactacatatggatctgttaaatgtgttcatttgtccacattgcaaaatggtactataaaaagtatataacaactataaaaagttatgagatgtatattcataagctttactagtctgctacaaaatgctggtatatgatatttcaaaattacctacctcctgttttctctgtgaaagagaagttattaatggttaaaattataataagtaaataagtgtgtgtgtatatatatatataaactgctaaaagtaataatggcaaaaatggcaaagggaaacaactttgtatgcaaatatgcttttcctaaggaaaaagagaatagctttgtcccaaattaaaatgacaaataatttaaaaatgtgtgagacaaaatgtaaacaaatatctttaaaattagaaaatgttcacagaaaaggaattttatttgtcatggttaaaacttttattcagtgtatttataagattttcaaaaaagaactaatatcaaatattatacttgtataaaattaaaatgttggtttctctgttaaaataacaaaattttcttaggctaggtgcagtggctcacgcctgtaatcccagcactttgggaggctgaggtgggcagttcacctgaggtcaggagttcgagaccagcctggccaacatggtgatcgcgcgactgcactccagcctgggcaacagagcaagactccatctcaaaaaaaaaaaaaaaaaattcttgatcattggtctgtccctaataaaaagttataaatggtctgtttttcttctgagtcatctgcctaagaggcaaagattttatgtcttatcaaaatactgtaatgccctatctgtatgttcagtttattatgtccttagttatttttttaaagtcttttcaattttaaaggaactgaagattctttacaaccatgttacctcatatgtttacttgaaaatttttacaactctgattcactagctaaccaagtagtatttctcgctaacccataatgctattcaatcaaatgttcgagaactcctgacaactcttaacatttgccttcccacaatcaaaacttaaatatattttatacctaaaactggctttgggatttgccagggaccttctggaaaatctcaaaggattagttctttcaccttgtaacaagaaaggtgcaaaaactaattagtcttatttaatattgtataaattgcattggaaacattgtcaaatcaaaaaaaaaatgcagaaccttccctaaattagtctataatgggtaaaatgtccttaatataaatattttagaaattccatagaattcctagcggggtttcagtgtcctcagtgtacatgagatattgctctttatcaaagccccagtgctgctttgccttatattagataagaacaatacaaggttatcaatcatcatttcaattatgggaaattcacattgctcactgatggaatattgttaatatacagatgtttaggacctttcctgaactgccaatttgattttattctgcacccaaatctcatggttataaatatgttcttactagtttatttatgtttttctcactggcttgaagctttcccttatataaaaggatcattgccactaatgttattaagcttttgttagaacaagtattccccacatgtggaattctaccgcttctttcaaatgactaaggaatccatttccccagtaaagtcatccaagaaatataatgagttcttcctttatcccccaaattacattgtccttatcatccccagtcgtctgaaatgatggaaacagtggagtattaaagtgaaaacttgccaactgatgaaaaactcaatctcccatggcctaaggttttacccttagcactgactgtcctctggtcctctcgtgctgggtcatacgtactctccctccatatgatataataactggcccacccatgagatctccctagtgtctagactctcaaagattctaatctggtcaattcagacatttaaaaataatgacaaggattttttttaatttttccatctactctccctcgaagttctgctactatcgttgcctacatctctgaaggctctcactctgcctgtctctgcccttcttggaactccaggctagttatccactaggagagcacatctagtggctttcttcctggcgtgtgcccagactagggctgagggaatgcttgctacttagaactattagcagtaagcagcccttaagcccctggcccacagactctaaatgctgcccatcaggtgccatgacatagttgacccttcctgatgaacctagcctactgagatgccatgccagtgaccagacccaaagactgcaaatagagaaccccagggggcccggaaaggggatttgtctacagtcgcaccccagcatgctacaggatttagaccactaagaggaacaggagaagagcacttgcagagtgctgctgtctgcctcagcaaaacagcagtgtgccagggcaatccagccaggccagcctaggtagggcctccacctgaaagccagaggcttgcctcaggtgcccttgtcagcttgggatctccacggaccaggcatttgctcagtcagttgcaggcagtatagaggcaggttagagatactttggccaccacctaagccaggaggggtcacatactccactcactcgaccagaaatgtggctttctaaattgtcacttccctctccgtcactgctctcccaagtcttacctgtcatccaatttgggatctcttctacttattttacagttctgtctccatctccacagctagtcccctagtccaggccccatcatttcttacatggaggatgctgtaagcacttcctcttctccctgctccactctgcccacttcagtcactcttctcactgccactggagatcccattgcaaagcaatactctcgccatatcactcccctgcttcaaaccttcctggctcctctttgccctcgaaagaaaatctaaagtccttgttatggcataaagttctgatcctgcccatctgtgtcaggggtccccaagaccatccctaggcttggtgattcacaagaagaactcacaggacacatcacatcatcacactcaaggctatggtttattatagtgaaaagatacgaagcaaaatcagcaaagggaaaagcacacaaggcaaatttctgagggaacccgggcacaagcttccagagtcctctcccagtgggtcacacaggattcactcagttcccctcagcagtgagttgtgacaacaagtgtgaaatgctgtcgaccagggcaattcatgagagactcagagtccaaggattttatcggggactggtcacgtaggcaccctctgcccagcctttacctaacatgcacacgttgctttcacctataggaaaccttccccattatcttgtagctgtaattatctgctcacccctcccacatccatcacgtcacagccagtttcagagtgtgtaccccatcaactgcacctgcttatcctccgctccctcctcaatccattataatccaactacagcctttcccactgccccaacctactcccctcaaggcagtcatgagttctacatagccaaatctgatgggcctatttcagcatctacagagcactggaaagttagctcagcgtggcttggtttccatgacggtagtctttcctgattcttccatttatccaaaattttccttctcaatacctctctgtagctcctcttcctccttaagaccttttggaattattttccaaaattatggtccatctgcctttgcttctctcatatttttacttcttttcattttatatattcagctagggttttaggggatcaataattaatatcccctctttttttctttttgagacaaaagaagagcagaaaatggagagaaatgtcagctgatgaagcagcttccctcagcatccctgaaccacgtggactcacccacccagccaagggcctggctggacaactgtccctggaagtctgcagagaaaagccgagaatacatgctttgtacacactgccttccaaaggcattctccaggcaacctcatgcattctctttagtgacttcctatgagctgacaactcccagctctctagccccaggtcagatctttgctcaactccacatttgtttactcagtagcctactggacatcactggctggagcccctacaggcacttctcattcggcatggcccagtgaccttctcatctctgtgcatctctcagcgggcctgcccccaaactccttaccctcagctagttcctgtcaccacccatccaattgcctagccctgaaatctggggagcaaccttggctaccacttttccctcaccgttatctttattttttttatttttattttggagacaggatcttgttttgttacccaggctggagtacagtggcaggaacatggctccctgtatcctcgacgtgcaaggctcaaacaatcctcccacctcagcctcccaagtagctggtactacaggcatgtgccaccacacctggctaatgtttttaaattttttgtagaaatggggtcttgctgtgttccccaggctagtctcaaactcctgggctcaagcgatactgccacctcggcctcccaaagtgctgggatgacaggtgtgagccaccacgccaagcccgcttttacctttaataattcaaaaatacttgcagcctcatcaccttgcccctggtgtaagcaaacagtctccaatatggcctcctgccttgtctcgtcgtatactcccctggcctggtcctccacagggcaatggagggatcttctttggactcgagtctggctgtggcactctcctgcaggaaaaccatcggtggctcccaaggccctcaggatgtgggtcacactcctcagcctaggagcaggtgcctgcccagcccctacttggtgcttcctgccaagccaggctggattaaccctcctttgtgatggctacctgactggatgttccctatacactttgtgagcctccactcggaatgccttcccaagcacgtctggcacatctggcaaaatctccctcagccttccaaacccagctccaacatcactctccctgtaaagaaagcctttcctgacactcccccgcaaaacgaaaacaaaacccagaaccactcgcctcctccttcatccacaagcctcactttttataccccttctgcatggaacactgactagttctagaagccacacaatgtgacagcaagtccaaagttgttcactctgtttttggactgggaccctccagggcctggagccaaggaatcaaagatgggctagatattcttagaaggtaaaacttgttatctaacagttgagctaggccctaaaaataacctaactattaataattatggaacctctgtggtacaagaagccccagaacaaagaaggcagatgactgtgtttctttcatccctgcaaaaggaaccccaggctccacctgctccccacagcagatgccctgctggattccactagctcctctctcggggcaatatgagtcttagctctctccttctacatttctgtcttgtgtaagaaactgttcgctttgcacccctggaatcactggcctgttgacgtgtccagagctgcaaggacatgcagtgtttgcgctggcaggcaagatgccttcaagagagcctgacttgaaactctcacaccaatgccacatggtcagctccagtaacaggcacgtttgtcctcttgctcatgcacagtggcacacaccaacacatggccagtcacatcctgtgtcactctctcatgcctgctcacacatgctccctttctctccctctggcctctctctctctgcttcactctgtcacttttgcacttttaccctcctgtttttttgctctttcacactctgtccttctctgacaatggcattttacccacacaaatagccctcactctgcccaggacccccacctgtagagcacctgtactctgagagacagccttccttcctgccccatgcattgggaattagccagggcttctcacacctggggacagacacatcctcctatcacagtcccctcccagctccttgagccacaagaagcctgatgacactgctctaggaccagggaatcaccatgacccactcacagaacaggagcctgggtgtgcaatgtgtcgggtattggcacagggtgtggggaagtggttcccatgtgggtcgcagacctcaacaaaaacatgggctccagaggcagagcccactgcagctcagcccttacctgctgccacaactctctcgtctgacaagttgctcagatccgctggggctgctctgccgctctggggtgctgggatctgcaggttgctgagcgggtacagctgggtctccttggccacctcttggagctccaggcctctcctgccaggcctctccgaccctggtggccacatccttcccctcataatcagccaaggccctgaagaagaataagcacccttatgaaaaaagtgctctgaaactaaccctgcctcagccccaggacgcaagctggctgtcacctcctgtggacttggagggactcatatccctgaaagcggggcagaaaggagccaggcacagccccaattccagggagcagacagtctcctccttggcaggagcccagcatcgctgctcccttctcactgaacaggcctccatgtgtaatagatgaagccgaagcctccgatgtttttattgttgttgtttggaggcagggtctcactctgtcgcccaggctggagtgcagtggcatcatctcggctcactgcaacctctgcctcctgggctcaagccatcctcctgtctcagccttctgagtagcagagactacaggtctacactaccacgcccagctaatttttgtatttttttttttttctgtagagacaaggtttcaccatgttgcccaggctggtctcaagcgatcctcctgccttggcctcccaaagtgcagggattacaggcatgtgccattgcacctggccctccaatttttggcttttgccacccctgaatccagcaagaaggacagggcttcccccagatgtctcaggcatcgagctcttcaggggtcctccctggcctcaccccatgattgcactgcaccctccaatctgggtaccgtgggaaagaggctgctagctgatcctccacttccacacccctcccatcaccagccccacaccgaggtgcaaggtactgcttccagagtctactaggccaggggcaaacaccaagttgggctactaagagagtgagcccagcatttcagaatgaaaatctacttcgccatcacctcgatcctagctcactctgaatataaccttcccaacatcaccagcctaccttcaatagctggtgggggctaccccgagacaagaacacgctacaaactaccctgggactctttgtatataggagttaactttgtctaggcaggcttcctgccttcaagctggaataacaaggccaacagaggccacactttttggaaagtatgccctgaaagcaacatgattcttcagcctcaggtggaggtcaagggaactaaaattctccagcaggcacaacaagctaattgccacctccagctgcaccaggcagaactgcaggcaagtgagtgtgacgccacacagtaactgtggggaaccatcccactgggcctgtgcttctctgtgctgcttccacccttagggtctgctgcagcccatgcagatccaaaagtggtctgcacaggtaacaccagtcccagggttgccagcagggtgccctgacacacccattcaatctctgtcagtgacatgcttgcttgagccaaagacaaacatacaaggcctgaagagcttgtctccctactgtggtagccctgagttagctttactatggatttaatcagagtcccgtcctgtcccacgtcctctgtagaaatacactagtagaggttgccctcaccaagtctgtggatagagccaggattatccacaaagagaaatttgggctctattgtgacacagggacaaatggatgaacaaggcttcttctttcctaggcctgtggcagggccactgtgattttaggacatatgacctatgtgggtcataaaaaggaaatcttaggcaaacactcacaggaagctctgctggacaatgtaacatccaggggaattacttcccagctatcctgtccgagctcctcatgaacttcctggaagtcaagtggttagagataggcaaggtaacataggggatggtgaccaacgggattttggattttggattaatttctctgaagcctttccttctgagtgtaattggaccaaagatccagtagcctaatacagccactgtcaactcctaacacaaccataatctacacacttccattcttttaaaaaacggaaattgtagtcccggcgtagtggttcacgcctgtaatttcagtactttggcaggcagaagtgggtggatcagttgaggtcaggagtttgagaccagcctgcgcaacatggcaaaaactcctctctacaaaaataagccaggtgcagtggtgtgtgcctgtagtcccagctacttgggaggttaaggcaggagaatcacttgagcccaggaggtagaggttgcagtaagccgagatcaccccattgcactccagtctggggcgacagaagtgaaacattgtttcaaaaacatatatatatgagatatacatcatatatatgatatacatatacatatacatatatagatatagataatatttgtagagatgaggtctcactacgttgcccacgctgatctcaatccccggaactcaagtggtcttcccgcctcggcctctcaaagtataggattacaggtgggtatgagccactgcacccagctgacacttccacccttgtactgcctccactggccaacaacggttgccagtggtgaggaaatgtggtgcctaaacttcacctgatcctcatgcagaaaaaatataaacgagaagcccatgcttgcaacataatgaggaaaacagcatgttctagatggaaaatttgatgacaaaagtttagtaggaagaagatgagatatcgtgtcatgtcaaatgaaatcaaaccaataaagctggttaagttagctttccaggtgtccctgaacacctctgagaggaggagatattcctctggtgctgcttcacttagctcgcaggtttaaatgtcctacaggctttacatatacaaaccgatttggccatttcaacaaccctatatggtaggaggtatgattaccactattccgcacgtgaggaacctgaggcacagagaagatgagtaacatgcccaaggtcacggtgcttgtaagtgacagagcttggactggaacccaaagcaccagagtccaggctctcaaccactatactataccgcctctccctgtagtgtgatggagcggcccaagatggaatagggcggagtccccacagtttgggacagttaaaactgtgttgtaacctagggaaagtaaggctccactgccctgcgggatgtcaggatgacgccacccccatggcgctccctcatcaaactcctagggaacgaagcccctcctcactgccccacagaccagccccggtcagcccgagggcccagcgtggttggagggtccagctgccttccctgtctgcacgtccacaccccctccccctgggcagccctgacgacccgtgtccagtgtcccagaggccatggccccagggctccctgcgaaacaagctcaagccgcaggggccccgttcggcccctcgcgggaccgcgcttcctcccgccggcgacggtccacgcgcggtcaccccaaagccactctggccgcggcttcagaccttacgcgggggaaggggcagccagctcctcgggcccattcgtgatcctcgggcgacctctggcggccggcacgggcatggcctcaagagaatccccgccgaggccgagctcgtcccgggcggccatttcactttgtggacggtcgcattttcccggcgggcactgcgaccgagttcggggcttcaagaaatggcggcctacgcaggcgtactcactacgggcgcgtgctcgccgaggtgcacaggcgcgcacgcgtcgcgtacgctggtggcgagcgcgcattcgcgcaggcgcacacgtcctgtgcccgctacccagatttcggggaaggtgaggggtgtggttctgtgccatccctttttcttttccgtccctgctgtcttcccaaatagatcgtcaaggctctacagcaaggtttgtcaaccttagcactattaccattttgaaccccataattctatggtgtgtgttgggggatgtggggcagcatcccagatctctgcatataagaagccagtagtgtctcccactcccagttttgacaaccaaaaatggctccagacattgtatcgtagcaggctggaagctttgggagatgcccctgggtcagaaccactacctgagaacgatggttctcgacctagcctggaaggagaacaaactggggagctttgaaaaagacacatgatggagacccaccccagaaaaataaaatccaaatctctacctgggacttcgggaagtttttgttgtgttgtaaaccaaaaataaaattctaagctccccagctgaatgaatggacacttctctcagccaaggggacacaacgtgaaaaactagttcaggtcatgatgagaaaggggaaggtcagacatgcctcaatatattctcctccctttggaattcatgcccaactgaccagtattaacattgagagagatattcagactgacaaaacagactccttgaagcaataatatgccaaattccaacctgactctagtatagcatcacatgacagacagcaggtaatgaaagaaattgaagtattttacaccaaaatatattttttgacatattttgaaatgacctggcaaagctgtctctcctgggggaaatttacattctgtagagaatctccttccctttccaggactttttctgatctgagagtctagcaccttttaaaggtctgaataagaaacattggccatctattgcttctaagggcggccacttatgagacttcacctatataagaactctggtctccacaaccccttatcttaacccaggcactcctttctattgattccaggtctttagagaataacaactctttcaaccaattgccaatcagaaaatctctgaatccacctatgacctggaaccccacccccacccccacccccaccacactcccagctttgaggtgtccggcctttctggacctaactaatgtatacctaggcctttctggacctaactaatgtatacctcacatgtattgattgatgtcttatgtctccctagaacataaaaaaccaagctgtaagtgaaccaccctgggcacatgctctcaggacctcctgaggctgtgtcacgggtcatagtcctaacatttggctcagaatttcttcaaatattttacagagtatggcctttttcatcaacagtgtatttcagtacttcctaggtgattctcaagtacagccagagttgtgaaacactgtaatcaagaaagtttgtattggccaggcacagtggctcacgcctgtaatcccagcaatttgggaggccaagatgggtggatggcttgatgtcaggagtttgagaccagcctggccaacacagtgaaaccctatccctagtaaaaatataaaaattagctgggcgtggtggcatgtgcctgtaatcccagctacttaggaggctgaggcaggagaatcgtttgaacccaggaggcagaggttgcagtgagtcgagattgcgccactgcaccccagctggggcgacaaagcaaaactctgtctcaaaaaaaaaaaaaaaaaaaaaaaacacctctgattttgcagacgtttaaacatcagaggaaagtagcgtgagcctggctctagagttggctggatctgggctctgttcctaagtgtgttcattacaggagtgagtccctcaattttctcctctgtcaagttgcataataagaagccttatccttttccacgtttggggaaaattaaggtgagatcacacagcatgttaaccatgttaaccagctgtaagttactgattctgggtcttgagactaggctccaaagacaagatttcataaactagtttttcgtagtttctcctgaggattttcttagagcctcttcccttggaactcagttctgccacttgtaaggccttggctaagtcacttaatctttctatgcttcagtttcccaccttacccatctcacaagttgctgggaaggctgtaaggcacctagcacagcacagtattggtgtcagctgttgttttcactctgattgttaattgtcagtgcaattcgaatgagaaaagaaacacaataaggcctcataccttagatatccattgcccaccccagcccccagcatcttggtttaagtaaaaaagcaacagcaatgtggtatgaaaatgcaaacatgcattcaccttttaaacacctaaatcacatgagactcccctttggcttaaaacttgaaataagatccaatctcttaaccatggcttaccaaggccctgctccatctgtggccctcctcactggccaagctccagccactctgtcctttggaacatgctaagcatgttcccacctcagggttagttggtttgtggttccttatctatagctctctccaccgtgttctttctagagttggctccttctcctctttagaggagatcgcctgagttgccttttccacccacctaagtagtaccctcctcactgccatcactctatctcagctgcggctgttttcttcggagcactatccttcccaggaggcacagagacctaggctccaggcttttgggttttgttgtaattaggcataaacctttgagagactgtgaggagaaccgtatgagacactgtgagtagagggctgtgcacacagtggactccaatatcacagtacaagaggccaatcaagccctacctagttcactgagcctcctcttccagcactccccaacaaggacactcatcgctgaccacatccagctacatacagtccccatgaagcccccttcccctgctctagcgctcatgtattgctctaatctggaccagcctttgcccaccccctgcctgagagttcctggagggcagaggtgtttctgatttgtctgcatgctccagcctccagcaaaaggcagttgctgtcagagtggttgctgactgaaagaccctttctgactatgatgtatttcctggccaaggcaacagtttagtggaaagctccctggccccagaagccagagggttctggttggggcttctgcccttgctatgtgcctcaggccagctcacaaaccttgctggcctcaccttcccagccaaaggccaatggacacacagcccaagctgcctctctccaccccagaagttcagcactgtctgctcatgccttacccctttgggtctgcctttgcatcctcctgggctgctgtgctgttgctcttcctatcagcagggacagcagagactgaagtggcactggagctgaggaaggaaacacaggcctgctgagatctcagaccaaagaaggctggggcccaggtcttccccctccaggctgccttctcaccagaaagggaggaactgtgtcttccagtaaaggctggtgtctcagtcctggcattagtgtggcaccgatgccactgtgtgtgacaacctcatgtcagctttggacatggccttagcacctgagttcaagagcaaacactgcccctgaccaacttgggttccctggggaagtctcctggttttgggttctagtatcctgtaaggtacctggatgtgctttgttcaaggaataggcagagggggatatccaggcctgcatgactcaatgagtctggtgcacaggtgcacacctccacttcttatataacctgtttatgtaagttcatacttggctctaaaccactattgtctgtaaaaggtataactgccctgttgacgctgtgtatgggggacatgtctcttggggcttggctcagctcaacatagcttgacatggcgggtgcacgggaacctagagaaagagagagagcaagagctgtctgtctttgcaggtggacagaggggagccaggacagaggggagccaggacacagcttggcttgcccgtgcccagggagagaaagaattaagctgctgaccctgaaggcaagggagagctggccacgcagctgtgcgtaggggccaccggactaagcagccaagacagggcagacggtgtgagagtaagctgctaatgagaaagctagtttgagaaagctgtgtaagagagctgctgctgagtaaagccatgtctcatttacctgctatctctcgagtgttcttccagctccctgccccacgtccacccattccccttagccctcagctgcggctggaacctgaccctgagcatgacgtatccttacctgacctacacctctgtagggtttatgggagttaagaaagatcgttccttactaggacttgccaaatgctccacacacccacagcaaagtggccatgcccactggtggattggtgggtgaaacagggcagacgcttacagcatgggaatgcacagcttcttcccattgtacctttgtgccccaggagccatttttgcccatcccagccaccggtcctgtgctcctgggaactgagccctctaatgctggctgcccctgggaatcttctccctgactcctgcttgctaaacctggctgtagtccctacagcagaggttctctgagacctcctagcaggatctcttcccaggctctgccttcagatgccctcctctctgccacctcagcttgggtccatgtaggttggtgctgggctctctgggtgagcagacatatcacccatccctcttcttccactgcccctggtcagagctccccctggagttccctgtcttgctgtgatcacctgatgtgaaagtggcatggagctgagaagttcgagggggatcctggggtgctgcagctgaggctgggccccaaaggctgtgtctggcaatgggatagggcactagggcagtggccctaaccttacctgatggctgctggtctaggcttgcaggactgagagttggcactgtgcccatcctggtcttccaggaaagaggcaaagctagcagctgcacacagcctgtgaaagaaggccagacctggtccaggttcaggactttgtgtctgtatgtctaccctctcccgagaaagtggatcctgccccccacagatgatgaggaccaagaagctgctcaaatggatgcttgaggaacaatatttatatctcaaggcagcctgacacctggggctctgtggcatagtggttgccctctggcgttgcaaatcatggctttgctatctcccagctgtgtgacattgggcatgttacctgacctttttttctgggcctcagttttaccatcaatgaaatagggatgctaatcatgtctgtctcgtaagtattctgagaaaagtaaatgagttcatagatgccaagtactttgaataatgcctgggccataacatgtgctaatgtgttcctgttaccacagggcccagtggctgtttatagaagcagtgcaccttcccagtccacctgtattcacccactcaatatggatttagtggggaatgtcttacccaaccttctcagggtggagtcacattctctgtgtctctgtaaaccaggcagactgatgctcacggcatgctgaacaatcactgcctatacaagcctgtgccctccactaaccagcacactcactaagaggtgctcttgtttggtcccagacctctttatgccagttgtatttgcacaagaaggggacagcagaccctggcctctgaaaccaatgtctctgagcagatccaaggaaaggcccctggggcagcaactcagttctttgagctgccactaatggagaagaatcactaagttcgatgattaagtaaatccatgaaaatgaatggaaaaggagagtggttgttgccatgagaaacaacctttcctttggaaaaacaaggcaggacgcgatggctcacgcctgtaatcccagcactttgggaggctgaggcgggtggatcacgagttcaggagatcgagaccatcctggctaacacggtgaaaccccgtctctactaaaaaatacaaaaaattagccgggcgtggtggcgggcgcctgtagtcccagctacttgggaggctgaggcaggacaatggcatgaactcaggaggcggagcttgcagtgagccgagatcgcaccagtgcactccagcctgggggacagagcaagagtccgtctcaaaaaaaaaaaaaaaggaaaaacaataaaggagtttgttgaaaattatagtcaaactaagtgtggtcagccctctatgttgtgggttccacatctgtggattcaaccaacttcagattgaaaatatttgggaccaggtacagtggctcatgcctgtaatcccagcactttgggaggctgaggtcggtggactgcttgagcccaggagttccaaaccagcctgggcaacctggtaaaacctcgtctctaccaaaaatacaaaagttagccaggcgtggtggtccacgcctgtagtcccagctacttgggaggctgatgtgggaggatcccttgagccccagaggttgaggctgctgtgagctgtgatcacagcactgcactccagccctggtgacagagcaaggtcctgtctgaaaaaggagaggagaggagaggagaggatgagatgagatgtgggaaaaataattaaaataggatggctgcatctgtactgaccatgtacaggcttttttctgtcatcattccctaaacaatacagtataacaactatttacataccacttacattgtatgaggtattataataatctagagatgctttaaagggtacaggaggatgtgcataggttacatgcaaatgctacaccattttatatcagggacttcaacatgcatggattttggtatatgagtgaggttctggaaccaatcccccacagatacctagggactactatataggtaagacaactgtaaaagactgggttaaaattcatgaaaatctagaagattcttcagatgactttacaagtaactttgaggcttggtttcattttaaggaaacagtggacagcacaggcttcatgttatgagggtgtataagcaggcggggtgacatggaggagaccagagccacccaatcacagtagaccagaagtctcttccgcgacagccatcagcagagccagtcaagctgcaccactgtggggagagtagcaggagccccgactggatagaaggccaaagattctgccatgcaggacccagtgggccatgggaaagggtttggacttcattctaaggaaaatggagagccactagaaggttttagcaggggagaaatgtgatctagcttatttttaaaaagatccctccaatgcctctgcagatggcaaaaagatgcaggctgcatggacagggctctagcggagtcctccccattagtggcagcttaaagaacagagtctctggtggcctctccttggacctgctcggagacagtggtttcagaggccaggacctgctgtccccttcctgtgttgacttgtgggcctggatttagaattcgggctctggttccatggcatgaattgcaaactattgaagttagtgagggaaaggggccctgggtgtgctgagggaagtaggaaagcatcagcagggccttccccacaggattccctccttggccagactgcagtaggatgcaggaggcagatgatatcttgcggttgtagctctttgcagacactggctttgccactcctccctagccatctgctctgaaccagaaggactctagcatagtttggagctaaactatttatgccaacatctgcatacctagcctttgccccaagaatgattcaggcttggtttggaaccacttagggacaagagggaccttgccactctgcaaatcacctgagaaagtggcccctgactccctccaggtccaagaagccagagcccagctggacacgctggtctctccagggctaccgcttttcctctccctgaacctcagagcagagctgcctggggtagggatggggcaggaaaaggagagaagggagaaagcaggagcaaagggcctcctagctggtcctcagagcttaaccaagaagtaagaaggtgccgactcttccatcattcagtcattcactcattaatttgtcccttcatgtattccctacacgttcatttgaccagcccaagaccagcaccatgtgagggctgggcctccagctgtgagtgggcctagtgcctactctggaggagcttgagggccagtggcagggatcagaaaaatgaacaagattccaaaaagtggaaagcccaaggacacaggatgtggtggaatgtgggagtgtgggagaagcagtagacaggagccataggaagtgaccagtgccccacccatagcagcccaagcagcctggcagcttgaccctggtctgtcaccaggggcatgagagaacctgcctcccccgggcagctcaccttcctctctcggagccgatgtctactgcagccaagccttcaggccgggagcccgtggctccggatcccacattgccatcactcaactgtgcacttgacctgttatgagaagtggagtatttgctgactctagttgcgttttgatctcatctaacccagatgccatgagagtgggcctcaagaccagaagcacaggcctttggctgctactctgtgctgctctgaccagagctgagccaagcccaagttgactctaacaggaagtatttctgtattttttccaaacctgatgggttggttgggagcaaggtggaaagtcaggaggaggttagttcgttggtggtggggggagctgattgccaacagagcaaggggcaagacatgtgggtctggtaataagccatagagggattcctttcctcatttccagggctcagggttccagctaggggctccagggatccacactgagaagacgggtgtgtgggttcttagctgtaactggctaccaggttctcactgaagaaatgcccagcctgcagccactgctcaccagacacatttggcactggtctggcttggaggacaggtcagtgggctggctgtgcagcgactggggacaatcatcccatctggactcatcatccaccgctatggctccaacttcccgtcctggacccctcaccccttgccacaatgtctcccttagtccacgggtcatcctgaaagtctccgctacatgctctatgggggcccacatactttggtcactgactctcccagactgccagcttggtggccttgctttgccctggccattggcagggctgctttgtcctgcagtaaaagcacagtgagtgtggaagcttcaggggaatggaaggaactcagcacaggccaggagctggggatagcctgccctggagtttggtcctgctctctaactggctccctgaggaatcatggcaggggcctacctccctccaggcctcattcattcattctttctttctttcaacagatgttcattaaagacctgcagtaccccaggtactgggggaacagtgggaacaggaccttcctggccccagctgcatccattgacattgcaccggaggccatggaagtccttcagctgggtgtatgtgggctccgtgttctgggaatgaagtgtctgcttcctgcactgagttaccttgcagcatctgtgttgggggccctgaaagcctcctcaccagccaagtccctctggagctctctggagcagggggcctccttgtctttgttgcctggggaagacctatggaggaaagaaatggaagttaaccatgcagcagccattcacactcaggtgtgggctgttacctcatcctcaaacgccagctgtctccacggagcttaaaacctgctactgggccgggtgcagtggctcacgcctataacccagcattttgagaggccgaggcaagaggatcacttgagccaggagttcaagaccagcctgagaaacacagctagactccatctccacaaaaatatttttgaaagttagtcaggagtggtggtgtgtgcctgtggtcccagctacttgggaggttgaacctggaaggttgaggctgcagcgagctgtgatggcaccactgcacttgagcctgggcacacacagcaagatgctgtcttaaaaaacagaaccaaaaacaaacaaaccctgctgattgacagattggccaattatcaaaacttcattactaatagctactgttttttgttttttgttgttgttgttttatagctactgtgctgggattacaggtgtgagccactgtgcctggcaatagctactgttgattgagcatttgagcctgttctcgtgactttatatgcattaactctgcaaatcaaccccaggatatgggcactgttatcacccatgcccatctttcagatgagcaaacggaggcacacaaagcccctgtgatttgccccaaatttcacaggtaataagaggagtagctgggatttgagttctggactatatccctgatcctaatctcctaatttaagcccccttctgttctccttcaggtcctcagggagccccatgttgtcaaatccaggagagacagtcccatcattatttcaaaccaccattcagtactgctgacccagtgggccactccagccttctcaccacccctcctcccttgatcctgtcaacaccacctgcctacctccctggccacacaccttcctggtctccgcctttttctcctccctttggcgtgctccaccacttgctgggctgtctcctcccctcccaaggtgtcaactgccacccttgaagcagggatctccacttgttcctgcctctcctttatactggcctgcacacccactaactcccaactggccctcaggaggcccactctcaacatggcgagaagagactgccctcgcccagctgtccccaggagggctggccaggtggctgccacctgcatactgaggtcggtgcccagcttccattggctcaccatgagccccatgtaaagctagtttacgctcatgatttcagctctattctgtctgcatataacgtggaaatctcttgagccctaatcactctctcaaacctcaatcacaaaccttaaaatacctccctcctggaaattttgacttcaatgcctacgaataaactcgtcaaatgagttcactcagcaaatgccaagtctttccatcacccctctctgtccccctgctccctgccccaactagtacaatgagctatggtgcagaaggtggaaggtgggagtagggcaggctgagcggatctgcctgctctggaccatgtgaccttgagcaagttacttaaccattcagggtctcagtttcttaatctgtaaaatgggcatagtgattgtatctacatccatgcagaatggatgctgccatgcagaatcgacaagccctcagatgctgcctggggaagaaactcaggagaaggacatgacccagaagacaggacatttgaggtggaacagaaagatgaagaggggaaagggcatctcaggcagagcctccagcctgcacagagaaaggcccagggagggaggagcctgcaggtggggccaggtactgagttcaggctgcagagcatagtgggaggggctttgcagggctttctgcagggggctggcataactacttctgccctttggaaacatcacccaggtagatgtggaagggagtccagggatgggacagtaggaaacggtcgcagacaactgggtgagtagcagtggaggcctgggccaggggcagagcaatagggatggaaacatctctaaaataaagtggacaggacttggtgccttgggggcagaattaaagtgggaggagccaaggaggagggtaaagggacctagagatcgctcaggactcatcttggatgtcaattcctccaggaagccctccccaagcactcccacccaccacactgttgagaggcctctgctcgaagttcctgccaccccagggattaagggatgaccttcagtgtacactcccgcttctctccccagtccctggccttcacaaggtaggggcccagtctccctgctcggatctctcctagcctccaccccagcccccgaatcctgcctgcatgtcacctggctgtctgacccccaccccagggcagaggctgagcccctcgtgctccctgctggttgtggcctccttgacccacccctccccagcacagagcctagtggcatggagagctgtggactctgacccagtgaccccactctattcccagtggccctctcacacaggcagggcaatggcctcagtggccttcacgggctccttagacccaatcctcctcccacccccaccaacatccccagcacggctgactggtcccatcttcagcaattggcagggttgagctgtcacttcccaggggctcctggcacacagcatctctggctgacctcattcatgctcatgtcggcgtctgcctcccccaccaggcagatggcaattccagccagggggtcctgttcactactgtgtcccagggtcgggcctgtgcccttacacagactaagcgcttgctccataatggttttctgagtgaaagaatgagatggggcagaaaacccaggtcgaccatgcctcccatcaacctgttggccctacagtggcagagccggccctaggcctcatcatttgccacctgaggctgctgcttccatctctagaatggtgtccagggagccaggacagcagcaggacccccatacctcatgccttccacgtctggggccaccaggcggagtcctgccctgggtgtcaggatctgcaggcggacaatttcctcacctcttgagctgcgggccaaaggagagacccagtgggttgcaggtgagaaaagtctcccccttcttgggctggtgagtgcggtgggccgcccagacccactgcccccttttgatgtgctctcatctcctccttggccttgagccttgttggtgctgcagctgagctcgggccactgacctgtaggccccttccccggtctcccacccctgacctgagcccagccctccctcaggcacagcaagggcccttctgggtagaaatgaaacctcccaacccgtgcttctaccaaccatttgcaggggcaaccgcagcctgtgaccccaccagggtatccaaagtggccatttgtgaggccaggggtagttctgcattcatggactggtggggactgaggggtacgagagactgagaaaacccacagaccaaatatggaatgaaaaccagtgggaggggatgtcgcagactcggggatgaggacaaagggcccctttgagctttcctcttgccagccacgctcagagccctcccccagatgaccacaggccaccccggacacacatccctccaagtctgatgcattctctggccgtactgcaaggcatgacgcccagcaggcttggccatggtgtggccagggccagagagaatatagagctcccaggctttctgggggtggacccttcaccccaaaccagacctccttaggtccatggagcaaagcctaattccaagccacattgcagtcactcctgcctttgtccctgggccctggaagtgcagacaagcctgagccccaggcctgccctggtgaagctctgggcccagcagggtcaggcaggggcagagaggcatggaaactgaccttgctgtgctgcagggcccagaacaggtttagccatgggagcagtggacaagcttcatggaggcatagcccgacccaggccagctgaagggagatcgggggaggaggaggaggtagaggctggcaggggtcctgaatgtacagactagatctggtatggcaaagggaagatgcaggatgggcttgaagtggaggtggggggtttataggttcagactggcactttaaagaggccactcaggggtcccaggaggggtaggggatggagtggccaaggtgaaagcaaggaatgagccatggagggctgggtcagcgggctgctcatctctgtccctccacttccaccctggccagggcctggagtgctcaaagtgaccagagggaaatggaagggctaccaaggacaaggcctctcccatcatgaaagccaggaggggccctagacacacagacagctctgacttctccccatctcctctcgtgataacgacgatgacatcgttgttgaggatgatgtcatttatgatgacagtataaaacccctggctgcctcatttaaatcaggtggtgccagggaacagggatgtcacaggcaagcacaacatattttctcactggcgtttctggctctgtcacagaggaaatgggaacaaagtgtcaccccagcctgctccagtgactgatgtcagactagggcaatgtgggcagacacagagggaagacggctgcgcgaagacagaggccgagatgggagtgaggcgggcgcaagccaggaaacaccaaggattgcaggcaacaaaaggtaagagaaaggtatggaacagattttcccccagagcctttggagggagcatggcccttccgacaccttgatctcagacttccagcctccagaattgtgagaggataaatgcgtgtggttttaagccactcagtttctggtaccttgttacagcagctccagtaaactaatacaagggtctctcctcccccacaacccgctaccctaccatctccccagactctcaaccacagacagctccagtccaagctgaagtccaggaccacgctggaaggctgcacacccttggaaggcacccaaggaagagaggcaggcatctgctgaagcctgaagcccaaaactgatcacagccacctgtgggaatgcgaccaactgtggcctgtgccaaacagtgtgtgactcattctgccaaagagcgaggaggcggggatgtggggcgaggggatacctccttttcactgcctttggccacatttccctcaaatgccagcaggtggagatattgatctcttcctgtatttgaataagggccctgcagctcagcacgcctatgactgggagcccccgaggataccagcacccaggcactgtggtaagtacttcaggtgcacgatctcatttagcatttgggacagccttgggaagtagctattactgctctccctattttatccacggggaaactgatgcatggagagatgaagagacttgctcaaggtcacacagtcagtctgatgcaaagccagggttttgtcctgtgccagaagctgtgctcctactccctgctccccagacgctctgccaggcagcatgctgggcagagcctaggaccgggacccaggaggccatgccctggtcaggtgaggcaagcttgaccagtgcttcgggtaaagcagccaggcctgggggccgagaaggggtgcatgtgtagaaccagtttctccaagagagggtccctaaactgggttcaggttgcaaggggggcaagagttatgaggagctgacctttgcactgtagctaagggaaacagggcagggcagggggtggggagagggtagcctcgataggtctgtgcctggggacaaggctgtgacattctcctcttccactctgccacaaaccagccttttctgaagtgctgcaggaccctgagtttgattgagtcattgttcctcacgggctgggcttctcagacaccaggcagataggagctgggcctgggagtactgatggtggctgcttggtccagtgcagcacctaacgtggtagggtcagagaagacggccctccagggtcaggatcagccagcagctttcctggaagctgcctgggtgagctccaaatattgagtgaccagaattggaggaaagaactatcagaagcatcaagctgagcctcctgttgggagcttgccccggaccctgaatctctagcctttatttgttatggcaacctgagcaaacttaaaaagccaccttgcaatgacaaccatatgatggggattaaacatcgaaaggaattttgtggaataaatgtcaaagtgccttttaaatctataatacagcacaatctaattctcctccattctttctctcttttttttcttgttttagagacagggtcttgctctgtcacccaggctagagtgtaagggtgcggtcacagctcattgcagcctcaaactcctgggctcaggcagtcctcccacctcagcctcccaagtagctgggactacaggtgtacatcaatgctcccaactaatttttaatttttattttttatttttttgtagagatggggtcttgctatgttacctaggttggtctcaaactcctggcttcaagccatcctcctgccttggcctcccaaagtgctgggattacgggcatgagccaccatgcccagcctcctatattatcttctaaaaggcacctgaggccaagcgcggtggctcacgcctgtaatcccagcactttgggagcctgaggtgggcagatcacaaggtcagcagtttgagaccagcctggccaatatggtgaaacccgtctctactaaaaatacaaaaattagccgggcgtggtcgcgtgcacctgtaatcccagctactcgggaggctgaggcagaagaatcgcttgaacccgggaggcggaggctgcggtgagccgagatcacaccactgtactcgacagagcctgggcgacagagcgagactccatctcaaaaacaaacaaaacaaacaaacgaacaaacagaaaggcacctgaaaccatttattgcctttctttaaaagagaaataaggagaaatgagaactgtatactgttatgggctgacttgtgccacccaaaattcatatgttgaggtcttaactcccccatgacctcagaatgttactgcatttggagatggggcctttaaagaagtgactaagttaaaatacagttgttagggtgggccctaatccagttggaccaatgtccttataagaagtgattagggtctgggcgcggtggctcatgcctgcaatcccagcactttgggaggctaaggcaggaggatcatttgagtcctagagttccagaccagcctgggcaacatggtgaaaccctgtctctacaaaaatttaaaaaaaaaaaactagctgggtatggtggcctgtgactgtagccccagctactcaggaggctaaggctggaggctctcttgagcctggaaggtcgaggctgcagtgagtggtgactgtgccactgcactccagcctgggcgacggagtgagactctgtctcaaaaaaacagaagtgattaggacgcaggcacacacagacagggatgagcatataagggcccagggagaagatggagtctaccagccaaggagagagactcaagaggaaccaaccttgccgtcaccttgatctcacacttctagcctccagaagtgggagatgatacgtttctgtggtttaagcgccccagggtgtggtacaatactttgttgtggcagcctttgcccccatatccctcaattgccaagtcccctagatcaggggtccccaaccccagcctgaggatcagtaccagtctgtggtctgctgggaatcaggctgcacagtaggaggtaagctagagatcattactgccttagctccgcctcctgtcagatcagcagattctcatgagagcgcgaaccgtattgtgaactgcacatgtgagagatctagattgtgcgctccttatgagaatccggtgcttgatgatctaaggtggaacagtttcatcctgaaaccatcccctgctccgtcccgtggaaaaagtgtctttcacgaaaccaatccctggtgccaaaaagactggggagctctgccctagatattgccttgtaaagaattctcaaatcttcctttccacatcttctatggaccaaagttcttatggggagagtcagacaaccagagaagatcaagagagggagagagtgaaaaggagaagcaccctggcagtctgctgcctggggccatggagggagctggcctcatgctcctggctccctctgccagcatttctgtctccctcccagactgaggaagtaaccctgaggacagtggtcacctgtctataaatggctgtggagctcaaattgggggattgctatggtattaggagagcctgaacagcccttgggggcctgggaagtgaccggtagggacaggccctctccccttctggatgcaggggtcttccaagggtgctacagagatgcagctcttaggagacctagatttgagcaaaggtctcaatccaggcaggcactttaaacagcagcaacagcaggtggtggctctccctgcaggacttagcaccattctgcacaaagtacaagaaggtattagttgtccacagacaagagagcaccattatctgcccagattctcagggatcagaaatcaagacaaatcacggcccttcctggagtgagatcaccagtgctcagcctgtccttgccccatcaccccactgccagaccctccccagctggcagaaccagccagccaggctggcgggaagccatcacacccactcacaagccagagtcagctctcggcacccacctgagctcctggctcccagcggggctaggcatacttggcaggcactcgatccaaattgcccgagacgctttggtcctgcctccatccgcactggcaaagaaggtggctgtgagaggctctggagatgtcagagcctcctccctgggcatgctgaatgtggctaacttattggagtgcaaggagcaagtctgacaatggcatgctactgccatggtggctggccctctcaaaccccaaggatggtactttttcttggggtgttcaagttgccaccaggctcagtggtgcaagggttaaggtgacacagatacgtactcatcagaccagagccaggtgctctctcccggggggctggactgttttgctcctttcagccctgggacatccagccagatgggctcttactgatttctttgtcccgtcttgtcactgggcacatggggacactgatctcgaagcccagcatggaggtgccctgactgaggttcctcagtgactgagtggcaggtatggcagccaccagccccaggcagagatgagcgcaatggattacctgtttgagccaggagtggatcttgccagagcaggtgggtcctggctcttctcagaaggcccgtcctcttccaccacctccaccctttgagcaagaagagaaacagcgctcgtggtcttcttggctgccctagagcttggaggcctcaaagaacatgcttccagtggcgtctaactgacccaacccttcaggatcacggccaagaggtggcccaggctgggggttcagtgactccagctcaggataaggacagcatactgggttgaatagtgtccccccaaaattcatgtcccctggaacctgtgactgtaaccttatttggaaatagggtctttgcagatgtaatcaggtaagatgaggtcatactggagtaggatgggtcctaaatccaatgaccgctgtccttgtaagaagagggaaatctggacacagacacacagagaagagaaggccatgtgaagacagacgcacagactggagtgatgcaggtacaagccgaggaacaccaaggatcaccaaccaccagcagaagccaggagagtggcctgggatggtttctccctcaaagcctccagaaggaacccaccctgctaacaccttgatctagacttctggtctccagaaccgggagagaatccctttctgatgttttaagccactcagtttttggtactgcgttacagaaaccacaggaaccaaatgcagccaggaagacccccccaccgccccccgttctctgtcacttcctttgtgctgccaccatccctgctctctgtattcctgccaacttcctggtcttccaacacagcaagctagtcccaccccgggcctgtgcactggggccctctgcctggggcagttggcatgctgtcttctcttgggtttgcagtccccagctagccacctcagcacagagagaggccttccctgtccactcaactggaagtccctcaaattcaagtttccagaagtttctttcttgctttcccccgaatattttcctcctccagaaggtgccctgtctcaactaatggtgacacccctccctcattcagctggagtatcccgacgttctgatcattccctgttaagccctgttcaccctttagggcccatctccaatgtcacagtcacctcccaggggaagttctcctgatggcccaggttttgatcctggatgagagcagaaggcaaggcatcaggcaagcaacaggggcaggggaacaactcccagagggccttggaaatgctccacgttgggtcaggggcccagccccattagccattggcaaatggaagagcttgaccacatatgctaccacagccacccaggtgcttgccaggcctccagacagaagcccccagcccctcacaactccccctgctcagggacagtagtcccccacatccacatcccctctccacagctcccacactacacccctgctgacggaaggccttcctgtggccagtaacaggcctccaaggtgtcccttgatgacacttacctcttcgcgataaacggtgcctgtgtctcctgggtaggactgctggaaaggaagcagaaaggcaatgctttgggcagagcccgtgggcaggtgacatcaagaccgctctacctcagagggtcctgggccctctccattcccggcacttcactgtccctggtggtagccgccagacctctccattttctagaaagtacatctgagaatctgagaaggctcagctaggaaggcccttgggggtgatctctccacccaccctttcatcagccagagaaggctggagctctgaggagaggagagctgtcctagagcctggagccagttggtggcaactcacccagtgctcttcttggccgctgacaggacgtaggagtgctcccggggagctgtcctcctcagaacaccgcttgcagcctctgacctggggtgacacgggatgggggagcatctgatgggtgccaagctggacatgctctgccagcctagcctgggatggactcggggtgacttagggccaccccagggaggcaaggggtgagagaaaccagatttgcacctgctccaaggactattcaaaggaaatgtagaacctgaaggaagggcagcccatgtttatggagcatgtggcatgtgcccggctctgcgccagatgccaacatcctcgcattggcttattgctcttctcaatccaggaaagtagacgctagtatcctctgtgatttacagatgaggaaactgagtccaagaagctttcattatttgcccaagagcactcacctagcaggtggcagagctggcattcaatgctaggcagctcctagcttctggctcttttccttgctccacccaggcctgggggcccctgccactgtgaactgttccctgaggatagccaatctgccagggcctttggcaatggggctttgctgtgattcctgcgccacagatgggtcagcagatatggacctggtggctggctgagcccagggaggggagggctttatttcctcagggcccaactgctgtacaggccccaagccaaaggcatacaaaaggtgcttaacaaacccttcctgtcatagttcaccagcactgggtggtatgtggtcagtccccatggacagaggactgaggaggggcaagggtccatggaactttgctggcctgtgtggacgagggcagcttggcgcagagactagggtagaatttcagcagcatggggcacactcccactgctgtgcatgcctggagctcagtttggggtccggggcattcagaacccccaaggcatgcagatcatgcagatagagggcactgtgcaggtggcttctccctgaatatttttgttcaactgtctcagggccctttctaacaaaccgatttagagccctgaagagcctccacatgaggaggcttttccccggacccacattacctaggttctaccccacagaaggttctcaagggcccctcagctggtccaacactgagtgggtggttctggcactcagagaatgacacctattctcatgctccgtgggctaccgctgatggcctacgtgttgtgcattttgtcaccccaaccagtacaattcattccagcagtcttcgaagactcaggctcctgccctgccccccgggatgcccaaaaggcaccattccattacctccgtttctgttcatctgaggagaatggcaccacctcctcctcctcctcctcctcggtgtcccctgatgtagagctgcgcctgatattgtagggtgccctaagagaggggagaggcgctttcctgtcataggctgccaccctcagcagcttggcttcctggctttcaacaacaatgacgaggcaagtcaatatctctgcctttgggccttaggtcatgccacttgttcctccctgagaccagctctcccctccctccctgttcgagcctctccccttccccagaaaggttacccagcagctccccaaccctggatgatggaggcaagggacaaacaacggaaagatgtggtcccctgggaactagagacacaattcacacctctgtccagagaaccctcctccctgagcatgcagtggggggtggggggctttgaaagggaccccaaggggagcactaagggaaaacccgaaggtttctatccaagaagcagctcagatttaggcacacaatgctcagactgacagcagcaccctgaggatccccaggcccccagcccagtgcagccaggcagagcacctgaggctcggccgggtgcagggccaagcccaggaagcacagccagccagcagcagcctcacgacccatgaccctttccccagatccgtggggcccctcctacaagcttcctgcggtctccgctctgcctcggatcagacgtgcaatgtgcacagccatccagttttctggggcttgttaccctctggtgggctccaggccacagctgcaactggcagggagtgtcaggcaggcgggacttcccgggctgtgctcggtggcaagtagtcagctgccttcagtggacccagagtttggacttgttccttggaggagggaaccacgctgagcctggcgttgcatactcacagcttcttgtaatcctcagtggtcatcttgtagccagaggaggaggggcggggaggaccagcgttagctgttctcaccagactggcagcactagagaggagaaggttccatgtgtctacctgcaggctccctcctgcctccagatttggccacacagcccagtggacacatgagaggtggaccaggagctgcctgggagcctttcctctttgcttttggccctgacagacacccggaactgcgccactcagagcagctgtgtaggcaaaccccaccgagcttcagggaacagcccagcgggctcttgcctgtgtctttgcttcctgtttccgggtccccttggcctttccagtctgacggagtcccaggcaatgcctgatgccaaggtgcttgaattgcatgcaacttcagccttctcaatgccatcagcaagtcaagtcaagggtgcccactgccaggctagggggactctacacccagcccctcccaaactcctgcacctctctgtcccattagccaggcctagtcaggactgaccccaggacaaggacactgttagtggcccaggacctcccagagacccacacatccacttgggactgccagtcccaccccagcccatctcctctggtcaccccaccctgctctccagggtcctgccctacccaggatgaaagctggcacctccaaggccccacagtcctgataggcagagcactgtctctgccaggagcccagaccaggccctcacacctccccactggccgactggccaacaccccatggacatacctttttggagtcccgttggccttggggaactgctgctggggctgggaagagctgtctatgggcttggtgaacactcccctgaaagagagcccaggagatgccggtgagctccctggagggactggaggggtaagaagtcagggcttggcgtgagtgggcacaggaaggccggcagagtcctgcggtcacttaccggatgatgtagccagtgggagcccttgtgctcggaggcctgccgaagagaagaaggggtggagtgaagcgaggcttgctggagggctgaggtcatcctactttatcctgcccttaacgatagcaaataagattggctggcaagtgctccaggtgtcccagtacagcagaaacgaggggtgccagccccctgtgcccctgatcaggtgcccgctatgctctgcctatttccctcatgctcccccaggaaaagtgccccaggtgactcctcatggcaggtgcctaggaaggcagcttgatggcctctccaaagtccagcttctccttggccagccagttcccagtgctgcgccgacggagcactgctctcagctgacagccctcccatcctctgtgcttggggctgaaccagtgcaagctggaggctccccagtcagagccagaggcttcccctcagcccggggtctgacctgatctccctcaacagcctccaccaggaaggtgcatgagggcttgaaggggagagcccaggcagcagccagccgaagccagctgtcccccttcctgtccctcggggccctctttgctccagctccttgcatgcccacaccccaagtcttggtggaagtttgagacgagagggcgcggccaggccttgttcagcggctgggaaacattaggctctgggtgcttgggacctcctgcttggcagcaactgagggggctcagataactcagggggcagccaagacgagcgggcagggagctgacagccaggggtggtcagcctggaagttctggcctccgggcaggagttaggggcccctgcaaagagtcctcctcagagttaggggaggagtcaaggggtcagggtagacccttctgtcctgcagtggaggggatgtgggctggagcatcggggtttgggtcaagggcaacacagagcctccggtagtctccaaccccacaatctccatctctaacaggggacagcctcccagaggtggccatgttgcaggcacacttgggggttctcgcttttgtattgaactgtttactagggtcctgcctgagtcccctgctgggacgtcagttgcccaaagacagggcctttgtcttgaccactcctgcatcctctgtgcccagcatgggacctggcaggtagtgggcgctgagtcatcgaggggtgacagagagaccgtagttactaaaggtagccctgtgtgctggctgtaaacttgaggccctcccttccagaggccgccactgcctctaccaccccctgagaagccgcctgccggctgtttggagcaaggagcgagcctgaatttcagttccctttctctgtcaggagcagttcctccagaggccagcagggtgtgcccacgcttcagagcccccctagacactgttatggaaaagcccccaaaagagagagaagccagttctccttggtcagctgacaaaatatgtcacggtaaacttgggagacagtcagagcaaactcgtgcctctctacaggcatgctgagtcccaagtacactcaagcagtcagggtgacctgcaggagtgagtcactgtgactctggaagctgcccaaagcatctcagaggcagtatcactccctgcagggaatgggtgggaggtcgtcttcttcttaaagacaatttcaatcccagttaacagctggagccacggaggcccagcagggaagtcagctgccccacagccacacagccaggccaagggcctggaccaagtgactcctacactccccttcccaaaaggaaggtgcagtggagaagcccctccttcctgcagatttcaaattactcattgcagacccttggctggggctgcatccctgtcccctgtggactgcccacccctccctgttgagggctggccccaagctgcaggagagtccctggggctgacccaccagccacctgagcaccacctcttacctaggcttcggaacctccccagctgatgaaaaggatgtggcgcgactccggcctgagggcagctctctgggggaaagaggcatcctgaaggattggctccgagactccctgtcacctgccatcctgtggcctccatcctagaggctgcccagcaagtcctgccatttctgccacacattctccttcccaggcacccaggggctctcccaccctgtgacattgctggatagcctttcccacgctctgccctccacatggcctggcggagctctgaatggtggaagccccttcgcatccccaggtatggtcggtcccccacggattgcgcgcccccacgttgctgcggtccctccccgcctccttgccttacatggtgcgaccctccgattcatcctgcttggtaatccagctcttgtcccccttcagcgtggttcgcactttcatctgcttgagaacgttattgcgctcctcctcgcctggtggcagaggcttccctgtggtgggaaaagccaaccgcctcagaagaggaatgcagccccaggaccctcgacctcctttccagttctcccagtatgctgctctccctttgctgctgggacagtgcttgtggcctgtaggggcaggcttggaagcaaacagccccaaacagagcctgggaaaccagggagcccaggcctcacctttggtgcggcctccaagagctgagatactcatggtgattgctccgcagctctcctctcacttgattcagcagggcttctggggataaaggtaagcaaatgctgtcacttcatgcatttgtagtgtcttgcaggtgaccatatgggtcctggtacaccaagatcatccagactgccctctgcacatcgggggtggcaagcgttggtggagtgctaagtatgggcagaagccagggggccagcactcactgtacctgctgctgcccagcggcacacccacctgcctgcccagggctgctcacctagagaatgtggagctcaggggctgccagggactgtctgttcaaagcgatcactgataacgggagaacatgagccctcctacagagtgctaacagcctggctcaggctggggggtgtggggaagacagctggcactggtggactcagagggtgggagagagtgcatccaaagccgaacagcttcagggcaggcagatggcctgtggagagggacgggctgggggaccagctgctttggggttggaccttgcttctcaccccttaggagttttctgacagaccttgggcaggtcagctaacctctccgagctgcctcagtttcatcatttgtaaaatgatagttaaaaaaaaaattctacctttcaggactgctgtgaggatggaatgcgccgatgctcctataagtacccggcaccacctgaaaaggagccaagcagcagtagctctcaagtcatctgctaggagaggcgcggtggtcctcaaacagcgccaagaatggtctggggtgtgcagccctgtttccttcgggggttggctccaccttcagtggggaaagcccagggccccactgccaaatcctagtggccctcagggaacaggcgagtgtggcaatgtggtaagttaggcttccttacgccctggcccacagctgccttgagctctgcttcctcttcctctgtgtcttctcgccctgctctacccctgagcccggtgctgctcatgctgcccagacggtgccacactgccttcagcctctctgcccttgagcccagtgctgccctctcgtgcccatgaggggtgagctgtggtggtctcgagggccatttgctccggagaagggcccagggtgatgaagctggctctccaggctgggagcgacccagagctgcagggagccctgagtggccacagccgaacccttgggcctcaaaataggggctgggggctcaggcttgtgggcatgacaggaagcagggccctggttgtgctggcatagtcacaaagcagaagagcctttctctccagggcctttcatcccctgggcccctccagggctagggtctgaccagctcagcactgctgccagctggcagggcctggatgtgtttctgtggaggtcaggggcacactcaaatgggcagggcagggggacgagagcaaaccaaatttgccacatcagcaagagctggctcttccataaactgcactgaacgagcagcccagacagcccgagcctgctgtgtgccaggaatggcacctcatcactgcaaatgggagccccgcgtgcccagccctgcaccaaagctgccacgttagagttctgttgagtggcgctcactccacaggtgttcctagggccatacaggcctaactgtccccatcccagcaacctgtggagtggccccatgggcagggcacatgtgcagagtctctgggtgccactgactgactacagaccttgggacagttcctcacttcatctgggcctcagcttttcacctgcaggaggacctcctagtctttcgtctttaggttccttctaaccttgctaggctgtactagctagtatgacttattttgcgctgggcacctcaaagacgtactcctttctaaggcctcagggactgtagccaccagcttccacatatgagcgtggcaagcaggtgacggtcatccacagtttcgggggtggactccatcccaggcccagtaccaggcacaaggactcatcagttaccccttgtcaaacctgatggccacattgcctagaagtttcctgccaaatcaggaccaaataagccacttccaaagtcaagacagacacttttgcacatgcagaatgacagaggcagagggacccatggcaaaggagggcagggctgggtgggaacaccatccgtcccctgcagagggcaccatgctgccttcagtcccgtctttatagctgagactccagtcagaagactccgggtttattgccagacaaagaccagggctggtgcttctgcatgggctcctttccctcacgcctggctgagtctcacaagtgaaatttcttttttgatgagacaataaatatgaaagagtcagaaaaatctctgccaaagtagagtctttccacacgatgaagtgtaaggcagttctttgggacaaggagcctttaaagtgatgagtgtcaggcagtgggatggggtgggatgggatgggtgggatggatgggatggatgggatgggatagacggatcagatgggatagatgggatggatgggatgggatggatgggatgggatggacggatcagatgggatggatgggatgggatgggatgaatgggatgggatgggatggatgggatggatggatggaatgggatgggatgggatggatgggatgggatggatggatggaatgggatgggatggatgggatgggatgggatgggatgagatggatgggatgggatgggatgggatggatgtgatgggatgggatgggatgggatgggatgggatggatgggatgggatgagatgtagtggggtgggatgggagggatgggatgggatgggatgggatgggatgggatgggatggggcggggtggggtgggtggggtgggcaaatgaggttggaatgtacatcccatctacagagctgacttctccctccaatttgccctggtctaggccacgatcccttgagacctcctccctggtccctggcctgctgcctttatctgcacctcctccaggcaacactcattggtctctaatcccacttggcccacatcagccttcaattctcagtcagcacctgatggttccacactgtttctaagactgggagcaaaatcaccagtcccctgagccagcctctttccccccaatgccgacactgtgctccaagcagaccatgtgccttggagtccctggaaggtagccctgccaagtgaatgcctgtgccttagcttatactggtccgcccacctgaaatgcccttccaacttccgccgagctaagccctgcttctccctcagggcccggcacgtcgaggccagccctgctcctactgggtgctcccctcccctaactcccacagccaggcacagacctgcagatccaagtcttcccaggcaagccctgctcctcccccaacctcagcaaggaccaagcccaggcaccctgtgacagcccagcacaccccaccagggagtgattgcctgaagccacctacccctgctcggacccaggtctcctcccagatccaccgtcccctccccttgtccagcccttcacagagagcagggcagagtggccctccactcagtgacagccaggaagacccttgctacggatgtaagcagccttgaaggatggaatgtggacccctccagaggtggcttcctggtggctcttgtgggaagggaaaccaggaatctcgacagaatgagtttctgtatgtatcaaaaggcttaagggcaggcctgctggtccagtaattcccctcgcagccaagtagcctgaggaagaaattgcacgagtacagcaaagatgtatatgaaacaggtgtcatcacagtgttgagtatgggggtgaaaatgtggcaataatctacatgcccatcaatcatatttaaacatattgtaatctatccattcaagcaaatactatgcagctattacaaatcatactgagacatgtagtatttaacatgctttataaacctgtattgtgtacagtttctatacatcactcagtgaaaagcagcccgtaaagcaggatgtgtatgatggtgtcatctaagtcaaaatatatttacataaaaatgcacaggggaaaaaatctgtaaagatatacaccaaaatattttgctcctttgtgtatttctaattttcctgtcatgaacgtgtatcttctgtgtgctaaagatgagcccgacggtggtttacccaaatgaagtgcgagtggagtatgcttgagcagccaagggattagtctcaagagttgataccagggccggacgtggtggctcatgcctgtaatcccagcattgtgggaggccaaggtgggtggatcacctgaggtcaggagttcaagaccagcctagccgacatggggaaactccatctctactaaaaatacaaaaattaaccaggcatggtggcatgtgcctgtaataccagctacttgggaggctgaggtaggaaaattgcttgaacctgggaggcggaggttgcagtgagctgagatcgcatcactacactccagcctgggcagcagagtgagactccatctcaaaaaaaaaaaaaaaaaaaaagagttgatgccaggcaagcagtgcctaggaaggatgggaggtgaggagaatgaacagatgcagggacttctcttgcttgctcactccgaggaggaaatccccacagcagcaagggcaggccctcagcctctggggcccagctgtgctgtgcactgctttgggccacgcagtgctgcagcctgggcctcttcccggggcctccttcgtcttttcccacaagctggggtggagaaggaagcggagagcaggcaggggtgtttcgggccggatgccaaacagaggttgctgcagcggcagtggcagtggcggtggcacccctggaagcaggaggccggcttctccgttcacacatgtacggggcccagggaagagatgacgggacaggagggcacatgaggcccactgatggctcctctcccaccccacgcaatcccgccctggctccccagcccatggcaagtcagccagagggacctccacagaaagcaaagtactccagggggcaaggacaactccctgctcacgaggctcacgtccagaatatctgaagagcctggtacagggaccggttatggctcaggtgtggacatgcgatgcctatgtctgctttcatatgggtggcagcagggggtggggggaaaggcccagtctacccagggagagagcacccaccacagaggcctggcagataaaccctctggccaccatggctgctgccccagggccaccctcagctctccgctctccggggcagtcattagcggatgtgaaccccatttgggaagccagtgaagcctccagagcctgtgtgcaggactccagccctccccagggctgcacccaggtcccagcaaagcggccagaagacccaaccactgggacagtggcctgggctccgctctgcgatgagaaccatgccgtcctctgggaagcaataacaacactggcttcccttgctggagcaccacccctgtgtcaggcgggcaccctgcatgcacactcctgggatcaggtctcagaaggccagcagtaccgtgtgcagcccacgcacaagagctgtgccaatgctcctgcttccccttcagcagagtcagccaggagtgggcccgtgtctggccctggccacactcccagggctctgagtcccagccacgcagtggcccaggtaagcccatgcacgacggcctcgagtgctcctggggcacacccactgccagtcgcctctatggcttcctccaaaccgctgggccccagcagcaatgctcacccgctggagggaggagacacttcagactcacccagctgcaccgtgcctgcctgtgctgctcggcctgatgcagccacagaggcctgccacatgtgactccaggaccccacggagcaggccacccactcccgcagccctacactctcactctccatctgagtccagtatgtcaagctctctcatgcctctgggcttgtgcctgagaaagactcagaaaaagttcctgaagaaaaagaaactgctgtaactggggttccctgcaccttcccatttaccctgccaagaagatggagagcaaatgttccttccttagccacctttgaaagtggtgccaggggcttgctacctgcccaagtcttccagtcttcctcttcctctgcgaactcaggcttctttcaaagtccattagccctgacacccagagaggccacacaacccaaaagcaaacactgtccccatgggctgtggcctgtgcttacatctctgctcctcttccctaagtggcctcacatggctgtgacatcccactctccgagtctaggtctcctcatctgtaaggtggcatctgtgggcctgctcactgggtctcttcctgacaggatacaccaagctagaacatgtgcctctctggatctctcatgccatgacacgggtgtcttgatggcctgtgtgggcacatttctggtcaggacagccactctaggccttttcagtaccatggccctcatttctaccttgatttggagaagacttctggttttttggaaatctccatatcatcctgcttaggacctggcctgggccaccaaaggaatggttggcttttctgacaccctctgcatgaactgtccctcgtggtgcacccccgaagccccacaagatgtggccacactccacagtacccctctctgtgctgactctgagcaaagccccgtactcaggcaacaccagcctgtcccagggcagttcagggccaagtccaactcctcttgcacaggccaggccacctcagacaccaggcagatgccccggcccgcccttcatccccttctttctccctcttcctgtctctggccaagtgggctgagagatggcaatctgaggaagtgtccctggcagggctgggcgggggagatgaggacaggccttccctgaattcagatggcctccaaatgcccatgggcatgttcctgctctacctttctccctgcctctgtggcctctgaaggttgcccagcaacctcgaaggaaggggcccctggccctgattggatagataggagcgaggagccaatgaggtggctgaacagagcctgttatcccgaccacagcaagcctggtgtcatcagcgagtggagtgagaggggagctgacgcagggggctgatgcatgcagattcccgtgcgctggaggagcgggggcggcagcaggcaatgacgcaggtgctggagcgtgaggagatggacacagacgggagcggcaggagaaaagactccctctcacaccacaggacgtgctcagcctccaagatgagaggactaactcagagaaagttttgtagaacttccccgctgcctgactccccgagggcggcacctcccagagaagctggctcgcaggggattaggatggctcccaaactgtgcagaagggaagtaggacgccaggcagggcctcctaagcaaactgggagggcaagggagcaaaacgccttcagccttgccttcccggagcactgaatatcgctgctcatggatgagatgcagccagagggcacaggtgtcagggcttgtctcagtgcatgtgtgctgggcactgggcgccatgcacaagcaggagcaggtgtgccacaggcagaggtgcaagcagaagggcttctttcccaaaggtgaattgggatgctttgcatccaggagctgagcagacacccagctctgccaccccacgtgtgccaacctcagctaggctcacagggatcactcacagctcagatctgtgtggacccctttggggtgggtcaggagtcagcataaagaaacagctggacagggcaagaagggggacacagcccagagtgctgcccctgcagtcaagtacagggaccaaatatggatctgtcaagtacaagtggatgaagccatcaagacttgggctgcccactgcagaggctgattgctatgttttaggaaacctctggctgtgtttcaggaaagctctgtctgcaagcactttcacgtggctctgggacaaggagctttaatggaggcagaggcccagaatatagctggggaccagcacataggcctgcccccatcactccagcagaaacataagtactcccatctggtcatgaggtaagtggtgaagggataactcccttgtctcccaagaacttgctcctagagatgggcggacccaggcagtgctgatccctcagcttagatacctgctggggctcatgcctgctggaaccctcagagaagatggctggtctctgggaaggagactcatcccagctttgctgccctgggcaaatcctttctcccctcatggtgtctgggttccctaccactcgataagggtggcaatgaccaaaccatggaaaaacacatgtgcaagggtgaccccagctgctacacctttccccccagtcctcctacaagagccagagttgggctttacaaacccaaggctccaggctgcccaagccccagagcccagccagcccaggtagctcccctggaggggagtccctggaggggagggactctggaggggagtccctggaggggaggggagtcccctggaggggagtccctccacccctccattctggtccaactcaacctggggaccaccagcaccagcaccaaggggtgagagggaggcagttccctcccaggctgtgaccccgccccccccccaagcctgtctgacagcttcatttgctggagggcttgccttggtaaaataggggtggaggtcaaattctgcatagggtgggggtgtcgaggctcctgtccatttctcactgtaaatgttccatttgggcaaagagcctccactggacctagtgtcaggaaaaagactcaaagaaaagtccccatgtcttaggtcctcttttgctgtctttcgagcaaatgcctgtgagctctgagtaagggccctcccacgaaagacccttcacaaacccctcgcagtgtcatgagctgccccaggaacagggcggtctgggtgaccaggagaagggcgacactgagatagtcagagctggcttgctagggaatgcagcctgctaaacaaggggcagcaggtggcttctcccagcccattctccttccttagagagcttccctctctgcggccagactgcagccctgagccagatggggcagcagaaacagatgctgagagggtagtaggggcatgacatgttcaggaggccccggcgcagagccagccatgccttatcatctgtcatgtcatgagacgggcacagcggtgccgtcagagatgtggagggcttggtcaaggccacaaagccacacatccatgctggctcttccaactctggagcaaaggaaggagtactgacgaggagtccaaggacctgggttttagtcactggacgcgtcactcaccctccctgaccttcacttctaaactttgaggtaaaagagaatgctctgtgcccatgggagggggaatgggcttaaggaagccccattctcaaaatgctccctggcccctgcacctggtcatgtgaggaaggtgtaggcttcagtgcagcccctccggtcatcaccaaggccacaggaccccaagcaatgatacttcccggggagggggctaaggtcaaaagcctagcgcagtggggagagccttggctgtggcacagactccccctggaggctgccatgggaagtgcaaggacaagcctgaggaattataaagtcaggaagcaccacctccacccccactcagatgccctcaccccgtcctttctcaaggcacgcacttggctgactcagtttggacccaggctgatttaagccggtgcgggtgctgattttctggaccaaaagggttggaatgatgaaacgttccatttgatgaagcagcctcctgtggccaggtctggtgaatcaggacattctgattcccagtctcctgcactggagtctcagcagctggcaaggcaacagtcagcagacaggttgctttcctctgggaaggggatggagcaggcaccgccacaggcaccgctgcagcggctgtagctgctgttccaggagttgctgagatccagggggatggggcacttcaacggtgatttagggaccgtgggcagggctgagcagctggatcccgtctgagcctcctagtctgctgctcagcgtgcagctcccaggaggcctaggctgggcccctcttgccagagccagagtgcacgacctgcctgggatgctccagtcccaggggctctcgcctggaggccaacagggtggcaggaaaaaggctcagcaagtggaaaaaaaaagagctgaaaaagacttgagttgcagaggggaaaatataatatggaaaaagaacgcatggcgggggtggtatttgtaaatgtgctttacaggtaaatgacttctgcatgaaagtctggaatttcacctctccccatcccacccctaacaccccagcatctagacttctcggcgtctgcactggaggggccctgggaggcagacttttaaggcaggccagctccttcccaaggtggtggggcgctgggggtgaggaggaggggagaaggcagctgggccacccaccgctccttggggcctcgggattcctcctggctttcatgcgcccattttctcgttctcagagagccagatacaagcgaccgttcagggaactgggccatttcagggctggcttggcttcaagggcccttggagatgtctctgtggagaacagagggctgggcagggaccctcttgtagggccctggctgcttctgtacccctcatcctgcagttgtctctgcagccagggaaccaatgtggtcttcagccaatcccagtcatgcagagatgctagtcccatttgcagacaaggcagccagtgagatcagaggaggctcagaggtcatggagcccacactccaatctccacagcacctctccctctccccctactttctttctttcttttttttccttttctttttttttttttttttttttttttttgagacgagtctcgctctgtcacccaggctggagtagcagtggcatagtcttggctcactgcaacctccacctcccaggttcaagcaattctcctgcctcagcctccctagtggccgggattacagacgcctgccaccacacctggctaatttttgtatttttgatagagacggggtttcaccatgttggccaggctggtctcgaactcctgacctcaagtgatccacccacctcagcctcccaaagtgctgggattacaggcgtgagccaccgcactcggccactttcttttaccctctttcgctctcccctaggaacacccccgcctacacacacaccactgctgccatccattcagtctttgccagagcaggccagtgacaggaagtcactccttcttgcccttgactaacatcagccaaagctaattccttctgtcctagatgcaggtgatcactagttaggagcaaaaggaacagaaagagcccgctgcctccccacttcccccaaagctctgactccctatcctccttctcccctcccacaaccctctttctcatctttctgcccactctagacccagagtcccctcaaccccacccttacctctaacactgcccctatttttggataagaataaggaagtccagagagaagaaagcacttgcccaggatcacactgccatgtatgcaacaagcattttcagagccctaaccgccaggctgggtgctggggggatcggcctagcggaatgttgccagagcactgcatttcccaaggaggtgcccaggctcaggcccaaaggaatgaaagcatgagtaagggatcgctggcacaagtggtgaagcaagtcctggtttggggttttgggttttatttttatttttatttttatttcagtttaaagcaggcactgcctgatgtaagcattttcaccagggatgccggttcttgtgattaaaatccttgtgcttgctctctccatagcaactcttcgccacatcaagctctctgggaaactgacctagtcatcacaaagtggcgtgctgagccaaagatcacagggactagaccaaggggcccggactgggtgcccgagctgggcctacagatggggccaaggccagggaccaccgccagcaaccaccagcagcctagggcttgcccactggccccagaggctatgtctcctctctgacccagggcgtggcttcagagctctgccgccatctcagcagcagcagccccaagggcagctctgcgggaagagggatggctcagcgggcgttaatgagtgggtgaggaattgctctcttggctggcctggacccacctccctgctccaggcaggcaccctcccagttcctagctcccttttgaggtgagaaatgagcacactcccaacaggaaaagcctagaccgtgtttctgaaagtggcctctgggacccttcggcagtcaaattccctgggagacacgcttaagctgcagattccttcctgcattccacctccgacattgagagtgatacccacagggcctcttgtcttttccttttccagtctcttctccactcagacctgtccctcccactttgctgtcagttctcagtcatttctgtgccccagcgcccaacacagaaagtgatcaagaaaacacctgccaaatgcatcaatatgtgtccctgagagaagttaatctggctcagtttctaatcaatggcacttgagcaagtccctctctgtgcctcagtttccctttggaaaaatgaactgacaacagccctgcccaccctctgacccatccaaaggctacaagtgaagaaagctaatgagaaatgtggcaaaatgttaatagcgggaattcagataaggcttcaggagttctctgcacgattcgtacaacttttctatgagttttaaatcaattcaaggtaaaaaaaaaaaaaattaaagataaaaagtaacaacagtgctggcatggtggcactcgcctgtagtgccagctactcgggaggctgaggcacgaggatcgcttgagcccaggagttggaggctgcggtgtgctatgatcatgcctgtgactagccactgtacaccagcctgggtgacaaggcgagaccccagctctaacaaaaaaaaaaaaaaaaagtgaaaacaaaaaagaaagcgagtcagactttagtaggcatgagaaatcaccctaagaattaagtgttctttagtgagtcactttaaatgtgggtagatactgtttgcatcatcagcagtaatttctaaactgttttcctcaggtaggggcccacatcccagtcagcatctctctctccacctagtcccacttcactccttgccaccacagccctgaaggagggcaccatagtcctggctcagctaccttccgtgacagagcacctctgtgccaggaacctagcacttgcaggcacccagtgcagcaggtgctcctggctttagccacccttcagtactggtgagaaaacagaggcctcaaggggttgcatgaagggccgaactttgcacaactggatggtggctgagctggggtttgaacccaggctgacctctgagccattctcttaaccactaggctatgaaggtgccaccctcacctgccacacacctgaccaggtgtgggacagttcagcccctcctcctcttcccggcctttggaagcaatgatggcaacctctcctgagcatctctcagggactggtcccctgatggcactgcccttgtcttggcatcagccggttcactatgggcacagtggtaacgaatgcaaagtccctggactgaccctaaacatgagagcccaaaggcccggactgcaaggggttgccgcactggagagcagctctcctctctggcactggtcctgtcccatgccgccagggactggcagtgggggcagcctcagggctcagcaacagaaggaaagcttgtgttacatgtgacctggcaccttataagttgtggcttgaagcaaaacccgcaccaaagggggcagtcacctgtggaagcttgagtagggaaggaggaaggcaggcttctggcttccagaatgcaccgagccagaattgggggagtttgcttggcatgcaactgaagacagttcagggaacaagtgccgatgcctatcgtggccaggtcctgggcccagtgctagggacccagagtccctgccctgccagatctcaggaggccttggggacactgggcaggaagacaaggagcacaagtcaggctgagggaggctgagctgaggcgctggctgcccctggcatcactggcctcacgtgggaaaggctttttctggagtctggacttgagctgagcaggaagtgaggtggacaagcactgctgccatttggattcagatggcaacttcttactgacagatggcctctctgtcactcctcagggcaaggcatggagctgatttctctgtgggcccccatatgcaggagctcagcaagaagtggtttatgatctttcaggagtaacggggaggttagactccagcagctccaaaggacgtgcgggccttgacctggtggctgccgagctcctcctcctgcttccaagcccttcgcctccaggaagccttccctgatcttcccagccaggggtgcctcgctgctccaggactgaggaacccctaatgttttcatgctactcggagctgcaacatcctaagtggtcctgggccacctctgttgcttgagtcatgagtgtccagaggatggaaatgaacagatcttgagcacctgctgcgtgtctggccctgcactgagtgccttccatcagctccacacggctgaatgcacagcatccagccaggggctgggaattgctggaaggaggggcaggtgagagggatctgttccttcccatcctgaagtggcctgggagcgatgaggggaacagcggaggcaccaaggcctgccagaaggctggcccctcatctgtgcatctgtgtcttggccacttgctggcctctgagctgccccttgtttttcagatgaggagcggaggccctgggaaggcaggacctctgcagctctgttcaggcctatcaacctgtgcacccctgcctcccgcccccagccaggtacgacagccagaagtctgaagggccatgagaccaaggcaggacttagtccaggtactgaagcctcaagcactgctggatggggtgtgagaggccctctctcggggctcacagctttggggcctcccatgatgccaaggcttcgtgccgacggctcagcaagaacacaactcctaccatgcctcagatgtcccaaagccgggacacacccaccacctactttatctgagtccccagcagccctgggtgggaggcagcttgacgtgtcacccccttaaaccgacagagtacccaggtgtccccagctcagaagtggcagatcaggcaggagcacctgagctttcggcctttttgtaaggcaaggtatccctctgcctttccaaagaggacagactcttggctccctctgcccccatcaaaacaatccagccacagagctggtgcagtgccgatcctgtcgataacacccagtgacacctgattcggcgccttctgtctgagtgtgagcagccaccatcctcatggccctccccaagattgccctgtacccagcacatgcacctcacaggccccagggcgattgaggggatcctctgggtgagccagcctctgggtctcagtttcctcatctataaaatgggcacagggggacggagggatatgagattccctgattcttaaaggcctgcagtcaactctcagagcatcctggcccctcgccgtttactaacaattaaaccgtgtctttcctaaagggcaagacagagggatcaggctggcaagggggacacttgcctctgtaggggacgctggcctcctctgcctgtcagtcttttcactcacagcgaaaaccagaaatccactgactcccggggggaacccgaagagagatgcttggagctggtaagggttatggatggggaaactgaggccctgacttgtccccagctgggcacggactgggtgccccccactgcctccaagcagggccgcatccaatggcgactcgacagccctacctggcaccggtgcccggctcgtggggcgggtggagggtcgggcagtcgcagggcgcgggctccctcgggtggacggcgcccggccgggccgggccgggccggggaggcaggcgcggggcgcggggcgcggtgcacagcggggagcgcgcagggaggcgaggaggcgcggactgggctccgcccgcaggagaacaaacaggttttctccggccgcccggagcctcgcccctcgcccctcccctcggccggccccttcctctgcccctcctggggtaggtagaggcgcctggcacattccgcacattctcccgccagcgtcctccgcccgcccgccccttctcggccccgccccgcggggctgctggagaaatcaagtctggggctccccttgtcgagcacggggcgagctccagaaggctctgccgtgatggaaaacttccaggcaaattcctccgggcccgtggcccccaggccgggaagcctccgccacgtgaagggcccccgctcctagttgcgcgatctggccccggcacagggccaacgacttccacagatgctgtcgggttaattcagtcgagaactaccgttcctagatccattttacagatggagatcccagacaggggcggggaggggggcggggggctggcggctgagatcatccaggaagtcctgcaggcaggaaaggaggagaagagtgagggagccgctcatcgtggaaggccatcctgggacggacccggggctcacaaggcacagcaaacggggctatctcccaggctgggcgacgagatacagccagactcccagagccaatgcggtttgatgtacctgtgtcacgcgttggtgctcaccgagtgctttattgtgtgcaaggccctgggctggggctaaggatggagagagcatggaggaaagacccctcaccccacggcctcccaaacagggagacaattaagccagcccaagaaatggcatggacttggccaggagttggcctaccagggtggtaggctcaaaagaatggaccagctgcttctccttcatcaaggcctgccaatgtggtgtttccatggccctccagtccacccacttctccctgtgcctgctgccaccaccctagtccagacctggccccgaagaccagcctccttgctggtgtccccctgcctctggtcttgccttcctttccctcagtctctacacggaggtcaggttaaaagttcacgtgtgtcaatatgatcaggtgctctcctgcttgcaactcctccatggcttcccattgctctcagggtaaaagccagactccttgagacgacctatccctgcaggtccagccactcttccctttgttcaatacattacagccacactggcctttttccattgccttctgaatacatcacatggcgctcaccttggggtgtttgctcctgctcctcggactccctaaaatgctcttcatccccgtcgggctagtgagctcttagtcattcttcaagcctccacccagtgtccggaaagcctcccctgcctgccacccagtcgagctgatcacttccttctgtgcaccccttagttccctcagatgacatcaatccagcatagtggctgtcaccctctattgttctagatcctgagctctgggagggcagggccccttctgattcatcactgggtcacggagaccagcacagggcatccgaagaatttgcagaaggaagtgatggatgggtgagtgaggctgtggaagctgtcctcatccttttcttcttggggttcatgagatagggagaaggcgaccctgtgtgtgcttagggggttgtatataaagtcacttctgttcatgtccgtctcttgccaacaagcatttttctgcttccaatattgtatgcccctgtctggtggccagcaactaacacctcccctcctccactgtggctactggtggccatggatttggcttggcatcttacctcctaaacatgtttactgtatgacttaggctgtgtcatactctttgtctgggtcccagtcctcttcaagagcccctagtttgaaagggtagaaggtagaagacatcatgatgggtgagatgtagggcaaggaagagggaaaaggcaaacttgttcaagagccctgagtcaggggtggggggcccagctggagagcatgagcaaatgtggtgtccaacggcacggccagcaagtgaggactgccccaggctgggccgccccagggcctcaagctcttcccatgtcccaggtgactcagtctctgcccaggcccgatctgtcacgactgctccagccaaagagatcagccttccctgaacccctccctccctgccaggctgccaggccctgcagctgatcttgcctgcaaacgggtttgacttgaatggtaactgccctgccctgccctgcccacctgtccattgccccaacagtcttccacttccacgcctgccagggcacctctagtcacctcagccaggcttcaggcacctgctggcttcttcagcctcttcaagcaccagacatgcccaaatgacatgtacccagatagaccaagtgctcaaataccaccaggacgctgcacaagatgctccctttgtttggaatgacatttcctccccagggacaccaggtggcctccactttctctcagcagtaacattatctccttcatgaaccttcccttagacctccctcaagttctaggccaaggctgtggtggctgctgcctgcctccaggctgggctctgtccctacctggcctgagcttggccctatcctttcctattcacatctcttgcacttttccacccatccgcagctccaagacaggccagctcccaccccctggctctggcagagttctcctgaagtccctccagcttaggcagcagtgccacctccaggggactggacagtctcttcccaccaacaagcaggccctcagcaaggctctaagtgagaggtaggggcttcagggtggggccaggctgggctgtctgggcaggcaagaggctgaaaggtagaggcagggagtagcaggtggtgagccctgtgctggagaagccatagctcacaagcaggccgtggaggcagcgtctctgggaggctgcatctaagcaatgagatgggtagcacggcaggtggctgctgggaaagaactggccagcagcactcctcagctccaggggaggccccattctgatctccagggctgggaagagaactcaagcaaggtgatctagccccagagttcccaggctaggaggtgggcacagtggctcacgcctgtaatcccagcattttgggaggccaaggagagaagaccgcttgagctcaggagttcaagaccagcctgagcgatatggtgagaccccgtctctacaaaaaatacagaaaacaaaaagagttaccaggctagagggggagaaagaggggttgggccctgaaagctgtcaggccgcaaagctcccccaggcagtgtcctcagctagaggggactgaagacaggcaggcaacctcaacacttcagttgtacaaatgggaaaacagaggcccacagagggacaagatgttgccaggattacacagctagtctgaggcagagctgggcttagaacctggggttccagctgctctggatggagcccctgcccagctggagagaagctggggtgctcaggttcatgtgcggggagggctgggctcctgcttgatccctaatcccctccttcccggggcccgccctgccacctcatcctcttaagctcttcaaccggtttacacttgctgggtgactctgctgactccaagcagggtggatgccctggaggcaggggtccccaggtgtgattgcaggtaggatgggtcctttgagccccgaacccgtgaggccaggcccttgtgtttgtaaccagctctcctgctaggagctggtccagcctctcagcatgtggagtggctgctcctctccccctgttctcagcctgcactccaagctacggggttgtggtccccctctctggaacacacacacattcttacttgccccactgcactgccaccccaaccctggccagagaccagtcagaccctgtcccggcctgttgcggctcccagtttgggggaggaggcagcccagttctactccaagggacagcagccatgcctggggattgtttgctgtgtgaacagtggtctcattgggagcagtggccttgtcacaaagcaaggagagaggtggtctgacatctgccactcctgtagcctggatccccactgccgtttgaatctactggttcgaatgagcccaggaaactctcagccatcagtcttggtctgtgtgacctgatgccccacaacacaggctctgccttttgtctgtggctctgaagcagccccaggccaggcctcctgagcacgagtgcgcgagtggagccaaggcctcgctggcagatactccctgcatgccctgaagaatggctttttgctgctttaagaatcatccacaggtcggaaaaagaatgttctaattggaaaacctccccgccatggttttccggagttttagtacagttggccggcagggaggctcctgggataaggaggaagggaagccatgagaaggagacagtgggctccctgcccagcgccccctcatccccccaagctcagctcagccactgccggctaggggccgtgccgagggcccccgcggtcctcagcctggagactctggaggctgcctggcctcagctgggagctcctcccccagagctgggcccaaccccgccccccaggggccctgctgctgccccagaagcagcccaggctcctaggaccctctggcagggctggtgctcagtgggcattgtgagtgtgcgcctggaagaggaaaggtgtggaagctgccacatgctcaagaaatgggaaggtcagagtcagtgttggggtctgtgagcaccccccgcccagacctctctggggccccaggctgggaggtctggcagagagatgcaggctgcaggtgaacgctaacttccgagcagctagatctgtcctgcgagggagggagctccgactctggggccctgctaagcctggcctggctaaaccactggctgagggagctgaaactacatcaaccagagggtatgtctggctctgagagttgcggatttgtttctttctgtctttctttcttttttttcagtctgccacccaggctggagtgcagtggcacaattaaggcacgctgcagcctcaacatcctgggctcaagcaatcctcccatctcagcctgcctagtagctgggactgcaggcacgcaccgtcatgcctggctaattttttgtagagatgaggtttcaccgtcttgctcaggctgatcttgaactcctggtctcaatcaactcatctgacttggccccccaaagtgcttatgcctgggattacaggcataagccaccatgcccagccatgttcctttcggctgggcactgcccttggcttgggaaatgcccacctgggaagaggaaatgcagtggatccctaaaacaccattgcaaatccaagtcctcttcacacaggagaggaaaggttactgggtttcacctcttaaagggtgtatgcttctttattagtttttcccagaaacctccctgggtgcttagctgccttgatttcctcatggagagcagcctttggagattagaggggagaacagctcagagggtgcccctttgttcaactgagcaggactgtggtccccgacctttggagtcagacctgctgcttttctccttcttctgcccacgctggtgctggtcagagcctcacttgatgaaaactctaattttctcagcatgggggaaggggctggctctcatcaaaaaggattggaccagcctggctgggggatgcatttggctcctgttgattgcatttggcccaagtaacctgtacttggagaccttgaactcgaccaaataactctagccttcctggcattgtgccgtctgttcctcctctccttcttccctgacctgtcccatcccaggccttggggactgcagctctgtaacctgtaaccagcacatgtctctagaaatccactgattactgcaggtgccactggccacatgtggctatttaaatttcagtgaattacaaaggaataaaataggaaattctgctcctcagtcacactggccacatttcaagtactcaatagccccatgtggccagtggctactgtgttggacagcacagatagtggacatgtccatcatcacagaaagttctaggattgcaccaccccgtatgctgcccttcttggagggagctatccacttcctcctaaactgaagccaggcaccctcccggcagctcaatccagaggaggctcttccttctcccacaccccagctacctcagaatagtccagtttgccattggatgaaaacctccccgctttgaggcccaggccaactggcaacaccatcccccacctgacattcaggcaggtctttgccctggatgtgagaaagtgactgggagggtgagggtgagagcagtgaggtgtggtagtgagtgtgtgacttgagcatccatgcttgtggcttagctatccccaaccctcaggctccccaggcatctcccaagaccctgtcagctccaccacagccgcttcttcccacaggtgcagcctgcctgctgttgcttcctccagaatagagaatgcaggctttccaacttcttgccccaacctcctctctttccagcaggctcgttcaaccacttctgtgacaactatctttcaagctcccaactgttggctgctccactttctatccatccattagtcctttcctctcttcatttccctccctatccagcttactcaaccgctgtcttgtgaacatcctaatcttctcaccctactgtctctttgtcacctccacctgatgataatggcatcaaatctggacaaagctaaatgtctatattcttcatgcttgccccaaggcaaagaaccatgctggcagacgtcacgcaactgtgcagaatggtgccaatataaacttctggattccactccttctccccttcatagactcttccctctttataattatccctttctcttctacatcataaaaatgtctgtttcatttggagctttcccatcaacataaaaaaaaaaaaaaaagaatctcacctgaccacactcccacctctagttactgccccatctctccactttgctattgagcaaaactcctcaaaagagttgtctagactcactgtctctccttctcctcccattctctcataaactcacccggatcaggacttcaaccctaccactcccttcacatcattcttgtcaccagtcatctccatgttgctaaacccagtgttcacatttctgccttcacttaccccgtggccacagttgatcactccactttccccttctggaaaaacttgcttctcttggcttccctgacacccacttatctggaggcatgaaggctatgagcacagactctggaactggactgcgtgcaaatcccagctgtgccaattaatagctgtgtgaccttgggcacgttacttgccctctctgagtttccatttcttacctgtacaatagagatgagagtgccagcatctaccttcataggttgttgtgagatgacatgggatggcgtgcataaagtgcttggaatggagtttgttacatggtggtgctcagtgaatgtttactattgctacttttgttacttgaaatcaccacatgaatgtctgagtcaatccaaatgaaacatgttcaaaacaaactcttgtgccaccatccttcaccttccaaacctctcctccctcagttttcttcatcatcaaaggcacctcccaaggcctaggtgtttaactgatctttccctcgtctcccatgtccaatccagcagccagtcctgattgcagctccaaaccatccacttccactgccactatcctgggacacagtagtgtccccgatcacctccttcccagtctcctggcttctgcgcttgactcctgcatctactttctgcaaagcagccagagccatcttcccctctgccctgcttgggtgataaggtgactccatgtccagcagtccaggctagaaacaggggcaccatctgagactcctcattccctctgccatccaagtctagtacctgctatggctccagcctcttcacgctctaagctcctgtcatatggaagccatactggacttcctgctgattcccaacataggcctccattctgtctctagaacttagtgctgactgcggtccctcgcactggttaactgctactatgctcatgtctgttcagaggtcattgccttcacaagaagtcatccctaaccaccaagacccagctaagtgtctcttccaccgccttccaccctagcacttattaccctgcagggtcgctgtctcctgtgtctcctctcccttcctcctggatgtaggaaacacacctcatgctagtatgatgcctgagtaggcacacaggaagcagctgccaaattgatgaacggagggatagagtgtagtttcaaatgcagtgtgtgatcaaggtggcattttgaatctgtggattaaaagtgtatcattcaagagatgatgttggaataactggccatttggaaaaagaagctagatttcctacctcactctccacaccaaaataaactccagatggctcagaaatttaatgtaaaaaaaatgaaaccataaaagtatgagaaagaatcctggggtggggacagcctttctaagtatgtcatgaaaaccagaaaccataaaagatggagaaattaaaaacttctgtatggcaaaacccaccataactgtcattagacaaatgacaaatgaggaagagttatttgaactgcatatgacagcgaaaggcttaatcttccgaaaataaaaaaggactccttttaaagcaacccagtaggaaaatcagcaaaggaccaaggaagtgaacagataatcacaaaagaagatttgcgggtcaccaattagcatatgaaggaaatgcaaagaaagtcaactgtttccacccctgcctcaggtatgtaaaacttaaaacaaatctgcaaaaccctggggtacctggcgtgtgggaaaatgggcactcttctgccccaggggctctgagagtgggaggataagtcagggcaaccttctgggtggtgatctaaaaatatgccacaaaatgaatgatgaggtatcccttggactcaacaatgctaacattttaaaattctttttattatctgacatacaaaaatagtacatatatatattatattaaatgagatgcatataaacatcttcatcccctacctccacagcaccattatctacacattctgccccatcctgatacaagagaacgatgtgtcctgaagcagatgaaaggtcaggttttctgcttgtgccctaaatcccatttgttgcctacccaggaacatcttgctaacatttcgccctttctcctgcaccatcaattattccctcttgaccggatcattctgctcagcatgcacacatgctggaattcttcccaccattttaaaaaacctttctcttgaccccatacacctttctagctactgtccattcattccccttcttccctttacatcaacaatccttcagagaattctctacactttctcagagtcctcttcctcccttctctttcactcccatcactacacagaaatggctcttgtcaaggtcatcaaccccctctatgttgctaaatccaatgatcagttttcagtttgcattttactggacatgtcagcagcatttaacattcccagatgtggagtgagtttatcgggatgtaactgcatcataagttcagaataccctaagtagaaaatgcatttaatacacttaacctaccaaacatcatagctttgcccggcctaccttaaatgtgctcagaatgcttacactagcctatagttgggcaaaatcatttaacatgaaacctacgttataataaagtgttcaatatctcatgtaacttattgaatactgcactgaaagtgaaaaacagaatagttgtatgggacttcaagtttggtttccactgaatgtgtatcgctttcacatcatggtagagtggaaaaatcgtaagtcgggccattgttaagtcatgaaccatctatataatatatcctggggcagaattgctgggtcacagggtatgtgcatgttcaatctgacagcagaacactgactttcctgcctaaacaattcccagtgctacatatccttgccaacacttggtgttgtcagatgtgttctattttctcaatgcagtggatagaaagtgtcagctcagtgtggtttggggttgtattgccagtaccctcgcatctaggcatttatcctcaggtagtaactgcatcagggggagataactaagtacctgtatgctcattgcaacattattcatgatattttaaaaaactcgttacaagataagtttctatcagaagatccattccaaagttataacaggatactatgtggccaatcgaggtgttgattttagatctctagttaggggcatgaaaaatgccaataatatattgttgaatgaaagagagaaatagcagtttgcatcaaagcaagttacatggcagcgtaaatagtgtgatttcacttctgtcaaattgcccaaaggctttgagaaacaccttccagagtgtcaacacttgctatcttctaagatatggattttgagagctgtcttttccttgtttttattttttatgttttattttgtgttttctgtagtgtttgactttttaaaaaatgggcatatacttttttcctttaaagaaaagcaatttgcaaaaaatgcattcttatatttgttacatttgcatatgtataaaaattatattaaaggtttcacatgaaactgatcataactgctgcctctaggaagtgggtttgtgtgggctgactgggaagatgctttgagttttctctttattcctttctgtactctttgaatttttatggcagtgtattactttcgtaataaaaaagcactaataaaaacaacaacagaaaagagttattcttaacacttaagccagccctgccagcccctgctgctgtgggcccagcccactcagccattctgaggcccccaagtacttcccaacaagcccgttcaatctgtgccagacctcctctggctggggagctttcaagctgttgagcccgtgccagtcactgggctgcccaggagagagttccttctgcttctgggtggtgccttgagccaagagcaatgtgtcttccctataaagcaggtgggaaggagaagccagccccccagaaggcccagagaaacctgaggagcacaagcaaggagccaaaggggtgtcagaggccaaaaaactccaatagcaaacaacctatgtttccagtggagcatttttaagtctgtaaaggtgagagctagaaggaaataaagactgcaaaatcagaaaggcgtagcgacactgaacgtgaacttatctactacacacttgtatggcagaatcaggggccactctgaactgagaaagaattaattttacctaaaacaaacaaagacaaacaaagacttcactcaggtgaagggacacaggcaggtgctgctgtacttggtgtcagtgtagagaggttgtttctcaaagaccaccggaagaaaatgcttcctccccatggcagcccttctgagctactggggactgccaagccaacgcacgtggctcagtcccttcatgagcacatcatgtggtggtgactgggttttcctctgtctacctgacagcccgtgagctctagaaggcagaaaccagcttatattcctccctgagtcttaggtaacaggtatgggggctggcacgcaccaaatgctcagtgagcattggagggaacagacgatgatcgtttccaggacagaaagaaaccagagatgccatttgcaagtgcccatgtttctaaactcaaggtttagaactagatgtctgccagtattgccacccaatctgcaatggcccagtatgccaggctcggggcggggctgtggggtggcaggcgaagcttgctcatgctgtgtctccaaattatggaggtgacaagtcctttgggttctagactaaggcagcctctttggacaagtttgtcttttccaagagggtagctttggaggagggaacatgatggcatttagccattcttaacgtttggatgaagacaatatttgttcacaagtacgaacctggtaaatacctggtatattttaaagacaagttaaatcgtgtttttacatgacattttaaaaagtcacacatattatttgttttaaaatatcagaatcgtagtggattgtatgaagtcactcctgcagacacttcctgaagccctactccctgctccctccccacgatacagggcttccagtggcccatacttgtgtcctgagcacctgctttgagccaggcctggaccctgaggggttcagtctggtaaaaagccacctagtactgaggcaaaaactggtagccagaggatggaggagtagcggtgatgggagagggagtcagaggaggggcagagggtgttgacggaaaaatagaaagagatggtcctcagaagaatagactagaaggggagcctgaattctgcagagaccatacccatttagagggggattccaagatctgttgagcctcaggcctcgcctacagcttgcatcctggcatggtgaaatgatgtctaccttgggtggatgagagctcctccagtcacaggtattagccagggctatgcctacagggcagttaaggaggctgctagatgtttagaaaaagagggaaggaaggagagatggggatggagaggaaaggaggaaatttcttgtcagtgaaagtcaaccatcagattgaagttgtttgtagtttattctctacttgtaaaagttggacttggtttttttccagacaaataagtctttattcctttcttatatttccccagaggaaaaggcagaggaaggagagagtgtcatcatgtacttcaaaagactagaaggaagagataagaatctcaaatgctataaagtcaaccccaagacccaagggggctcctgctcagcttgggaaaaaggggtgggagcaggagaatggcgcaggcaggcccttccctccctacatggtcaagattccacataaagtgcagtaaacatggactcatatttatccaccttctattagctcatcttgtggccactttgatgtaggtttcttgcaccagcagaaatgttcctacgtggctgggatatactttcatctccccgttctctggcctccactcccatcttcgacaagggagacctctcctcctaagactggagagttaaactgtttgccccagccccaaattgaaggactggtgtttggtgtgcataatagccaggaatgagctttgcccaaagagagtctgggctgggaaggagagacagaggggcctgctggcctcagttacttgcacagatcttttattcaggaattagagactccacgggtaacagttgggggaagggaataggatagagatctgattttcacttgggagacagtgaggctgtggggcctgtatggcaaccgagtggataagatgagctgacaccaggacaccacaggggaggagctcagaggaaccgtccagggtagaggccaagcttgtaggggcagaggcagctagcgatggccccttgaggccacgggagggcatgacatcacctaggcagtatgggaatggttgagtgtgtgttggatgatcagagaaggccaggaaggagctccaaccagctcccctcaaagagatcccccacgcaaaaagagcctacaggaaggtgtcaggagtcacctttgttaagatgcctctgaggcaaggagcagaaacctactcaagtctcaaagagccttcaaaagggctcatgtatttcccccactcctcccccttcccatgagacagccagtgtcctttgattttcccaaacagggtagggcggcaggagggtctcagagcagccaggggctcagggaagagtgaaactgagtctgagattgacattttaatctggtctgagttttaacaactgcaagacaccagtaacttcggaaacttgctcaagattctgttaatagatgggcaaggccgatttgacaaagctcagctgaagggggtgatttgagggtccatgttgacttaatgctttttatgtcaggtgctgtcccaagcgctctactgaaaacatctcattccatccttgctacagccctatgacgtaaatactattattatccccattttacagatgaggactctatggcacggaagggctagtgagtggtggagctgggatttggacctaggctgtcttactctagagcccggactcttaacttccaagattattaccccactgggttcaaattgctcagttagccacttacatgcggcatcggggactgttcgtgggagctgtgctaacaatgctaataataaagctaatatttgttgagggcttactacatgctaggtatgatgcacagtgcttctgtcagtaggtgtcctgagaaaaccctccttgaggtcttgatcctcttctttctgccactttgtaaggaggctttcttcctttggtcaacattaaattattgggatcctgcaggccttagatgtaagagaggctgatgcaacctgctgcttatgccagagtttaaacatctgtgcaaaatgacacatttgaaagaaaacatgtgattggcttttagcaggatatttctagaaggatcagaggatgacttgaacttgtcagcctcgctttgaatgttcggctgcttgcaaggagagcaaggacttcactccacctgtccccagcaggaaacgccccacggctgtctttctttcagggagatgtgagctcagcctggctgctcctgttgaccctgctgagatcctggcagatgtgtggctccttctggggctgagcgaggcagagctgtgtttcctggactcaggctgcccaaaggatatcttcccttgctccccactggctgctgcccttaccaccatgcggcaccctgcatggtgggcaaaggagctgtgactcttccctcccctttgggctagggaggctatgtggttcacgggaggatgctgaacctcagagcagggagatcatttgcccaaggccatacagctggaaagtgggtgagcctagataccagtgcaagtcagctggaacctttcagagacgtgagtccactaggtcaactaacctgccccaggagacagctcacatttttaacaggtatccctgcagactcaggtgtgctccaaggactgaggactactgcttctgagtgaggtggacacagtgagaaagggagttttaggagagagatgtaggggtggaaccaaatcagttgtgggcccaggatgcttcctcaagctggtttctcagctttgggtcctggggcatgaaagtaccaaggataataaagatatgaagacattcaaggatgaggacattgaattaaagtgcatttcattcaaaagtttcactgttggcctgccactgttctcaactgaatttcatcatttccattaagatgagttggcctggcaagacttggtttgcaattgcagtgtataccaacatgaactcggtcatggcataagatcctttgaatacttggctaagattttgtagagttttttcttttttaaatctatgttcatgattgagattagactcattttcctcctccattccattcccattagtgagggttccctcttcgcctagtctgcggtgaatggctagtgaatttactattgaaaccatttcggtcttgtttgggagatggaggcatgtatcagacagggttccatcagagaaagaaaaccagtaggagatacatattaagagatctatgagaaagaattggcttatgtggtggtgggggctgactggggaggtccaaaatccataaggcaggtcgtcaggaagggcatgcaggaactcttggacgtgggcccaagctgcaatccacagacagaatttcttcttcctcagggcagtctcagctttgctcttaaatcctttcaactgattggctgaggcttgcacaggtgatctaggacaatctccatacttaaagtcaattatgaaagactttaatcacatctgcaaaccaccttcacaacaccacctagataagtgcttgattgataactggggtctgaactgttttaactcattaacacttacaacagcaaatcagagagttatcaagtgtttgagaagctaaagatacactagcaccacagggcagggcagtaggaataggattggcctttcaacaaaaagtgctgggttaattgggttcccatatgggaaaaaaaaatgtctatgaatccttactacacatcatataaaaaaatcagttccacacaaactgcagacctaaatgtgaaaggtaaaacaataaagcttttagaagaaaaacataggagagtgtctttgtgaactggcaacagccaaagatttcttaagtgtgacacgaaaagtgctgagtgtgaccaaaaatgtgataaattgaaccatattaaagtgagaaacttctgttcatcaaaacacactgttaagaaagtgaaaggatactcaacatgtgggagatcttcaccatacacatcttcaacaaaaccctcatccagaatacatcaaacaaataaacaactccaggccgggcacagtggcactcacctgtgatcccagcattttgggaggccgaggtgggaggattgcttgagtgcaggagtttgagaacagcctgggaaacacagcgagaccctcctctctacaaaaaactagaaaataaaaaagtagccaggcatggtgaagcacgcctgttgtcccagctattcaggaggctaaggtgggagaatcgcttgagcccaagagttggaggctgcagtgacccgagatcgcaccactgcactgcagcatgagcaacagagtgagaccctgtctctaaaaagaaataaataaatacatacatacataacataataaaataaaattaagaagacagaaaatactgattgttggcaactagaatactcatattttactggtggggagggtacattggtacaaccacttgggaaactcagcttacccactgaagccaaatacacacatactttctgacttagtaatcccactttcaggttcccactcaacagcctacggatgtttttaaaaacatgtacccaagaaatactcagagcaggactatttgttatagccaaaagcaaccctaatgcccattaaggtagaaggaacaagtaatttatggtgtcttcacacaatgtaatgctctacagcaatgacaatgagtgtagaaacaaatggatgcagctcacaaacataatgtcgagggaagaaagctaaacacctaagagcacatatagagtgatttcttgtttttattttttatttttattttttgagacagagtttcactctgtcgcccaggctggatttacagtggcacgacctctgctcactgcaacctctgcctcccaggttcaagtgattcttgtgccttgacctcccaagtagctgggattacaggcacataccaccacacccagctaatttttgtatttttagtagagacagggtttcgccatgttggccaggctggtcttgaactcctgacctcaggtgatccaccgtcctcggcctcccaaagtgctgggaatacaggtgtgagccaccacacccggccgatttcttttaaataaaacagaaaaatgggtgaaactaatttctgctcctagatgtcagggtagtggccatcttgtttctcggtttgggtgctttgacatggatatgttctccttgtgggcagtcatcaagcgttatacttatgtatgacatgcacttttcaaaatgtatattatgcttcaatacaaagtcaaaaaacacgagagcatggaactctgaggttttggggttttttttagtttttttgatcttttttcatgatctgaaggattgaaagataactgagcaggaatggcctttctttctttctttgttattgaacaaagacggtcattgtactacccatcatgttcaagtccatcccgtgggacacacgggtgaggtttttagtggtcagtgccaggagcagatctgcctggtgcatggatggtgctcctggccacagggtggaggatgaaggagagatcgcacggagtcagggagacctggaatgggcctgtcactgttgtccaggttaatgagtggcaaagtcaaaggcaggattctaaccctcgtctcctgaccctgtccactgcagcatgcctgctgtctgtccaccaaagaccctgctgtcgtggggacagccccagccctgcacctcctcctcacgcccttctggccttggtcggaatctctctcagctctggctcctggctcagatggcctccgacttgcaggctcttgcctccaggccttgcacgcagctacttgcccagctcaactgatgctcaccccctggggccctggacgcagagggattcttcttggttctacaaggcagggggtacacaggccctcaggatcacagggatgcattctgaggagatttgaaagtacacatgtttttgtaagcttctgtttagaacggccaataagacaatctcagtgatgtgcagagtgcaaaggtatgtgattaacacacacgcacacacacacccacacccacacaaactcttaatcacagaaactgtttgtgttatgcgtgcttgattggccaagtgtgcccacagctggccgttttctgaagcccatggagctaaagtgagtagacggccgtccccagccatgtttcgtgggcacaacatgttcccacaagacaaggctcatagcccagcagtcccagatttcgcttgtggctagatctgggcacagaatggagatgatgtcatcagagcttcacgttctttcatccaattagctgagagttaattagtatttccaaagggctttgaagatgaggagcactgtttattcacagttggggcggtggcaagcctggagaggtaatgcaaggagttgacattagaatgagaagacggagccaatgctgccatctctgcctggctgagaggctgttgtgagacatttgtgaaagtgtctgtatgactttgctaggatagctggaacaaagtaccacaaattgggtggctggaaacaacagaaatgaattatctcccagttctggggccagaagtctaagaacaaggtatcagcagggccacgctccttcaggagtagaggaggatccttgtctcctccagcttctggtagccccaggtgttcttgacttgtggctgcatcactcgtctctgcctccatctccatgtgactgtcttcccacgtgtgtctgtgtctctgtctctccttatgaggacaccatcatgttggattagtgcccactctaatgatctcatattaacttgattatatctacaaatgttctccttcccaataaggtcacattcacaggcactgggtgttgggacttcaacatattttttggaggaatactatccaacatataatggtgcccatctgatctccagtggccagtgggtgcttcattcctgtgagcttcccttcctcactcctgttctcagcacaggaacctgagaatgactgagcaggccatgcttttctaggaagagctggaaagaagactctgggaagagacagaagttgtaatagctcttctttcatgaatgggcattccttcttcaaagaccttggccaaatctcagcccctcttggagtcttggcccacttgtgtaagcaatgcagggctgacctatgtgccccgtagcctgctctctcagctctaaacactgaaggtggaaggtcaggctgaggaggtgctggaggctggctccaagagggctctgggcagggcctgccccatcctcaggcagtcccaggccaacttagatccacagaactcggattctggaggattcctttagccctgggccgttactgttttatcattattcctgggctctcaagcctcctcttgcccacccccgggaagcttctcccttctcttcagttctattcaactcatggcacgaatgcctgtgctggtactgcaggggtcacagggaggctcccagcagaccctgcctttgaggactccttggtctagaaagaggcaggtccagagcccctggacacaatcattagctggtgccaaactggacaggcacagagggagcctcactcgaccaggctactagcccatagagatacatgtgggagtcaggcaggcagacagggcagaaggcattgcagagagaggccccccagttcagcaggagtccctctaaagctcctaagcagcccatgctcaccaaaggcagtgtctcagcacccagcgttccgagccagagccggctttgaagaagggagcaatcagacactcatgctgacagaacagggaccttgggagctcctggttccacagtggcatgaggtgccctcacctgaacagcctgcagtgccctggggccttgccttgcctctctcacagggcccagtctctgcaggcttggtctcagtgccacctaggaccatgttggaagcccctttgtttgggctgtggctagatggcctttggctgggaggccttagattcgtccctgaacttcactcccctaaattctaatcccagcagcaaacaaggtacaaagaggatgtgtaagtctgagtccctcccctgcaggacctgaagtccagacccaggattggaagccccagtcccgagcctggaggcagtgctgggacaggcacttgctcacctgggccgctggattctcgggcctttgtgaacctgccctgccgatcctcccacattttctagcactaagttggcaccatcctattggtgacttctgttcagttttcacaatcactagctggtgccaaaccagcccagtgaacgatctggatagttctggcagacagggctgtagtgatctagcagagtttcctcaaggtcctcagcctactgaagccaagcagggtcttttgtgaggtgacgctttacccaagggcttgcctctcttagccagcttcatgtccacattctaacccctgagacctgttactcttcttaccttatatggcaaaagggactttgcaaatgcaattaagttaaagatctttaaatgtggagattatcctgggttatctgggtgggccctaagtgtaatcacaagtgtcctcataagagaaagtcagagggagattttactacagaagaagagcaggaaatgtgaccatagaagcagagattggagtaatgtgcttcaaagatggaagaaggggccacaagctaaggaaaacaagcggccaccagaagctcaaaagaggaaagaaaatggaactcctccctcggagcctccagaagcctcagagcttccaactcctggactttagcccagtgaagctgattttggggttctggcccccacaactataagataatacatttgcattgttttaagccactcaactggtggtaatctgatacagcagtcataggaaaggagtacatccagtgttcccagccagtacagaggcaaggagttcaggccactcaacattattccaagagagtagaaggccattgaggaaaaggatgctgtccctaacttgctgtgcatcttcagaatgcccctttccctgtctgaaactttgggcttccctatacaaaatggggaatggggatattgggagaccttgctggactcaacaggcttgttgaggatccaaggagaaagtgcttgaccacctgggaaggcactggctggctgaggaggcactctccttcccacaaccctgctcctatcatcttgctcagcattcatctttggtttttcctctaatccgctcccatcaaaaccactcaacaaacctgtagtgcccacggcctggctagcactgtctgggtcagaagctggaagggcccccaaaaggtctaagaaaatctatggttgagaagagcgccatcaaggaagaatatggaagggaggatgaagaaaggacacaagtccatgagcagggtatgaaaatccacgctgggcacaagtgtactgccaaataggctgtgctgcagcttccctggggccgcttagctcagctggcatcaactgtggttctttcccttagctagatcaggagctctggaaaggctcttggatagactgtctaccacggtggcccttacccccagcacaaggccagttataaagtgggtgttcagtgttagatttcagggacatttccttgctcagtcttcagcctctttaacttcccagcaccacccacgctgctgaccatcctctcaagcttgatccctcctccctagctttccttgacacctgggtatttcgttcacttcttaattctcagggtcccatttttttcatcctcctgcttttcctgtggctttcggtagcagcaataagccaagatgtccgaaataactatctcttgccttctagacttttctacctggaaactgcaaggttcattcaactcattatggccagaatggaattcagcttcttccttgctgctacctatatctcatcctctcctgggtccctagctcagcagaaggcatggctggccaccaattcttctaagcttcagcctcctagttctctttatcccttcccctcccttagccccacatccaatcaatcatcatggatggtccattcttgcacagaatcatctcttcattacgtctgcaccatagccccgttgcctgttcctcaggacagacacactcttaccgtctctcccctggactagaggtagttccccactggcgccccacctctggtccctctccctgcactctccccaccatccaaacacaaatgtcaccatgtcaccctccagggagttatcaagtccaagctctatcacccaggctggaatgcagtggtgcgatcttggctgactgcaacctccgcctcccaggttcaagcaattctcctgcctcagcctcccgagtagctgagattacaagcgcctgtcaccacacctggctaattttttgtatttttagtagagacagggtttcatcctgttggccaggctggtcttgaacttctgatctcaagtgatctgcccgcctcagcctcccaaagtgctgggattataggcgtgagccattgtgcctggcctatttttttgttttgatagtagccatcctaatgggatgaggcgatgtcgcatcgtggtactgagttgcgtgtccttaatgattagtgatgctaagcatcgtgtgctcgtggcctctcagtccctcttaagcagaggttgacaaacctttccttttcttctttttttctctgacctcattcttccatcacaaaaccttttctatgaagggcaagatagtcaatattttgactggctttgtaggctagatggcctctgtcataactactcaactctgctattgtagtgaaaaggcagtcttagacattatgtaaataaatggatgtggttgtgtgacaacgaaactgtatttacaaaagcaggtggcaagcgagattggagcctgagttcatagtttgctgacctctgctcttaaaggaaggagtgcttgggttattaatttctgcatttcatttcttctatgggactgtgagctctttgagggaaatggcaggtgcccagttaaaatgttttgaattgatgttccccctgcccaccatggagaacaaagccagtggtgtgcatgtctcccagtacctgctacaagaggcatcccaaaagtgttgctgggagccaggctgtgatacaggacaaaagaagctgagaggcctccatcctcttccctccttttctcccctaccccagtcactctagaaagttctttgggaaattctctgggccgaatgagttaatatgaacagacctcctggagccggtaagaggcagagctggcaaagagtctcgactttgggtccaccatcttttggagccttccacgatcaatgactaggcagtgctggtgacaagagatacagactggaatggaaggttctagtgtctgccaacatatcttctttctcacagttcctaatgatccatttgtgctttttcagcccttcatgttaagagaacctcagggtggagcccatatcctgactgcctccttcccacatgggcacctatgtggcattaggctgcctggatctgaatgggtgacctggggtgcgctggcctgggggatcaggagctagtggtccagccctggctctgctgactgcccttgagtgcccttggccatggcctcttttctctggggctcccccagattgccaatgagttgctggctttctcctgtaaatgcccttggagtcttggcacatgaactgggcatgcttacttccctggaacaggtaacgaatcaaaagcccttgaggagcaaagcagttcatagagctctatctgggcagctaagtggatggttgccctgtgatggaggaagtgctttgatggagatgtaggccagccattgtatgaagccagagagacctgtgggggacagctgcaaagaagaaatgatgttggagatggagtttgaagaagagtggctggccctgcaggaccaggtgccctgaggcaggtgagctgagcagaggacagtgctgctgatgagctgcgggataccggagggaatagcgcctgtgtaagctgcacttgctggggtttggtgagggaggaaatgagggaggacaagggaagtcacatccaatggtgtttcagttcagcagaaggtagagctttctactagcaagggctgtctcatccagaaagctaagaatcttccaggggcaatgggcaccagagcccagagggctggggccagaggcctcaaccattgccatcctgtctggcaagccctcctcctcgtggattccagtgcttccctgttttgaagccatggaccccatgatggaacagccagccacacacacacacaggggtgacgatgaggcctgggagccccactctgcccttggcatgtctctcctggcccctcccccgacagctgctggccccctccactcactagtttttattaggccacagtcctctttgagaagctggtgaaagccatgtgccctttcatgccaacacacacacacccacacacacccacaaacacacccacacacccacaaacacacacacccacacacacacccacacacccacacacacacccacaaacacacacacccacacccacccacacacacacccgcacacccacaaacacacccacaaacacacccacacacccacacacacccacccacacacacacacccacaaacacccacacacccccacacacacacccacacacacaaacacacccacaaacacacacacacacccccacacacacacacacccacacccccagaggctgcatcgaatttagggagttcacagactcctcaagccccatctgaatggcaggttgggaacctctctctgcttcaacccagtctcatgggctgtgcctttccccattcctgggaccactttcttttgttgctactgtgactccaggattccaagacagggaggtttcctgagcacccactatgctgtggggacactgattgcctctgtccttaagaactcctggcctggtgggggcaggaaaaagcacaaataggaaacacaaaatgaggtacaggtcaggggccccaggctgggaatccagagaaaagaggtggtttccaactgggaggattaggcatggctttttaggggaagggaacgggccattctggagctgggacacagtggggagaggacatcgcatgcagtcatgacagcctgagcaggggatgcatgacagggcgtgaacaggaaaccgtggttccatttggctacaacacagcaggtgtgaagaccagtggaaggagctggaaatgtgggctgggagaaaatcggaccctgctttagtgtttttagcagagagactggataccctaggtgtacacatagcagctggatgggaggaggggcgaaagtaagcagacagatcaggtcggctgtcccaggacacctgacctaggtgcagatggggtcaggtgctgaactaggtcagtgtcgatagggaagggaaggaagagggattgaatgcgatcatcccaaaggacacgcagcacttggcaatagggcttctagctgtccccaatctgggagagaactgccttcccttggccccgattctccagatgggatgtgacacgagggacagacataggcctgggtccgcactctaggatgccatcagctgtcaggaaagaaatgggtgggggtggcccccaggccctgggcctgtgagtagggcaagttcagtcttgcagcagccaaggggaggttctagctggactcagtgatctgcaggaaggcttcttcactggtcagaaaccatccacagggcttgtgaagagagtgctggcccaagcccagggtctcggttcagtagctccggggtggggcctgatggtttctaacaagctctcagcgggtactgaggttatggtttcctggtggttagactttctccaaacgggtgggtcgagataggtgtgggtcaggaatgcagggaaatacaaggagcggctgggaggtcgtcagcttggccagcggggggctcagggtctctgtgcacagcctcacctttcggatctgagcaggcactgtttctgcaactgttctgccgtgatcgccacctgggccaggcttgcttgcagccctatgtccctctcatagcaccctgcacttttcttttttggaaacttcagcagttttgaataatctattggtctgtgggctgcgtgttttattcaccactgaagcgcagggcagggcccaacgattatctgtggtctaatgagtgaagagagggcagagaagacgttccatgagggacatctttggtctagatggcagctagtatttttctgagcgagtggttaggtcgaagctgagggcagtttggtccttggtgctcatcagcaaggtctgctggcctcacccactccgggcccgacaccatcctcccaccagcttagagctgctctgcggcttcattccagcctgagtggcctcctccctccctctcactccccacaggaaatcaggtgctgagcgcggaccccctccaggccatttcttgtaaggcttcatttctacccccaaccctaccgcccccgcccaactccatcatcgcgtgggcctttgttgcttcttgtctgaaggctccacgtaagagccacgatggtttccttgattcttggccaccactgcctgggagataaaagtacatccccttcagctttgcaccatcagccaaaccaggctggcacgtctgtccttcactgaatctaagacaccgttatctcatggacccctaagaaacacaacgtgctgctaattaaactatgacatgccattgactgtgaccctctgacatctttagcctgaaatgccaacttcgacagtgaagtctcactgcttatccattcttcaaggtccgactcaaggcatcacctcctcgacagaagctgaacatttaccactgcgtcttaagtgtgtgtatcatgtcctgcctggcattacaggggcttgcgaacatatcttaagtccatgattctaagtgccttaggggcaaaggctgtcttatttatgtttatatccccctgccccatcagcagagggcagcacagtctctcctcattccgaggaattatcctctacgctatgccctttggaaactggcctgaagggttctgagggtgagctgcagggaaggagcccctcctgctccctggcttactgtcgcccagcccagtgtcccacattaggagaggagctgaacagatgaaacagggtgccactgggctggatcactgccttgcctctcaaaacaacagaactctgttgataagagaaatgttttgtgaaaacagtgcaagcctgctgtggcggcgcacatttgctctcaggaggctgagatgggaggactgcttgagcccaagagttcaaggctgcagtgctctatgattgggcctgtgattagccagtgcactctcagctgggcaacagacacactcagactctgtctctacaacgaccacaacaaaaaacaatgcaggcaggcacggcaacgtacctgaaagagaatgtggaacatgtaaggagttgaacaagcaacagagactggggaggaattacagtcatttcagctttcagcttttgctctaagctcactgtcagtatgaaatgtatatgtaaagtctcacctgtgtgttaacagcttctgtttttcttctgggatattttgaagatagagtatcttgaacaaagtctagaggcttcactctagtattggtctgcatggaaatggttctccatcagaactaacaaatgggttgtagcttcctacagcttccttgattatgtacaaggacactggaatgaaatgtataaaccagaagagggggcaagggagggggtaaacagagagacacaaaaagacagagaacaaatcggtataatatgaagctgcctgcttcaagaaatccaaatccagttccatgaaggaagaaatgtctgtttttgccgccctcatcgtcacggaaagagtagggtgcgctctctgcctagcagaaggagtcacaggctcagagcaaactcattcaaaggatgttatttcatcaatccacaggggaaggagtgactggctgagcaacgtgtcgagagagcccagcctccagtgtccctcacttgaccctccgcaggtggcgaaagctctgcacggtcctctccatagcatcatccatggtcactagtggctggtagcccatggcctttttggctctctcgcagctgtagtagtggaatgtgccagccagtgcgacccgcatgggtgtgaaggtgggctgcagctggatgacaggactgatcaccatcaccagcagggatagcaggagggccaggtagtaggccacccagtaggggatgtggtacttgggggcctcataattgaggcctgtcaggatgcgagacaggaatgtccagaaagggatgggctcatcattggtgatgtgaaatgcctggcgggagaacaagaacaagaagttagaaacaccacccccacctgcccaaagttgaagcatctattaagcccgtgcagatcgcattctcactgcctaattgctgcagctttccacgtggcctgccctcaattgcacaactgctaaggcatagaaagggcagacaatgaaagtttcatctatgggccaggattttaaatgaagcatagattgcacttggaaaggcacatttgttaatttgataattgttaatcatcataaaactcatctacatatctttggatgcaatgaattcctcatattacatttcttgacggtgttctgcttgttttaaatcaaaagccacacccgggccaggcgcggtggctcacgcctgtcaccccagcactttgggacgcagaggcgggcagatcacctgaggtcaggagaccagcctggccaacatggtgaaaccccgtctctactaaaagtacaaaaaattagctgagcgtggtggcatgtgcctgtagtcccagctactcgggaggctcaggcatgagaatcgcttgaaccagtgagacggaggttgcagtgaaccgagatcacgccactgcactccagccagggtgacagagtgagactgtctcaaaaaaaaaaaaagaaaaaaaaaatgccacacccaccctattcccaacttatttgaaggttatcagtggggaaacggcagaggttcaggagaataaaagaggaccaaacagcaagggagggagagacctgaggaatgagtgggagaaagggtgaggagcaagcaccctgcccaatctacgtgggctcctgccacaaggagccatgccaacaggtgggcagccaggtcaggggaccatagatgaccgtgacctgaatgtctgttcaatcccagctcgtcagctctccaaatttggctgcccaagtgatgtgacgctgcagtgacaccacatgctctatcagaggggcttgatcttggcacagggggtcctaaggcagatcctccatgatacaggatcacaggagcaacttgccagcaaatccaatggcaaggagaagaaacccgcagaaaggcacctgtgcagggaccggtgcagcaggccttaccttcccacccagtgtcgagtctcgggagagctgctctgccgccaggatgtgtccatggaccacgttctccacaaaggtgaagtccaccaagttcttcccatttctgcaggtgcacaagggatgatggaatacgtgctgggagcccctgcacgaaggccagggccactcccaagtcttggcatttgagagactgtgacctacagaatggctgccacctcacttggcaaggccggcccaggcactcatggatgcctgtactggttaaagatgtacactgggccgggactcctgggtcttcagggttagtggaatctgaaagctgggggacctgcccacccattccagcatggccaacactggtgctgtctctcctgtcccgatttgggtagcagcttttcagccccttcccaggagacacggggccaacgccttgctctggtcctccgtttattgaccagtctccctgtaatccttcaaggtgacaagtcagggtagcagtgaggctgagtgagaaacaggaaggcaaggcagagggaaaaaggaaggaagagagagaggagaaaaggaggaaatgaaggaagagaaagcctatttgggagagaggcacactgttgtcccctgtggaggcccctccacctgcacttaacccgaggagaaaagtaatgcccccgcctgccttcccagatgcaaggacagtcaagccctggcctttgacccggggcccattgctttccctctgagtcacggtttcttcaatttccaaacagggtcacaaataccttcccagcctacctgagagggtacactggattgaacagtatcctcccaaagcttctgtccacttgggccttgtgaatgtgaccttatttggaaataggggctcggcagatgcaattagttaagctgagctcatactggggtagggtgggctttaaatccagggaatgatgtccttataagagggaaatttggacacagaaagcaaggaacacagccatgtgaaagggacgcagaggcaggagtgatgcctctccaagcacagaatgctaaggatggctggaagccagcagaagctagggcagaggcctggaacagacgctccctgcgaacctccagaagacactagccctgccaacatcttaactgaggacttctggcctcccaaaatgtgacagaatccatttgttgttttaagcacttactttgtggcaggttgttatggcaactacaagaaatgaatacagaggacagcggacaaggtcactgctatcgcctgaatctttgcatccccgcaacattcatatgttgaaacttaacctccagtgcaatggtactgtgaagagggacctttagggggtgattaggtcatgggggctctgccctcgggaatgggattagtgtcctcataaaagaggcccaagggagcctgtttgccccttccaccatgtgaggacatggtgaaaaggtgccactcatgaggaacagggcctcaatggacacccagtctgggaacgccttgatctggacttcccagcctccaagctctctgttgtttgttacccagtcttaggtattttgttacagcagcctgcatggaccaagacagtcacataagaaaagagctacaatgccatgtggctcctgccaagtgctctctgaatgcgagcatggaccaggaaggactagggaagagccgctgtgggctgactcacccaatcacgaacttcatcttgccgttcctggctgcctcgatgaggatgggtaccaactgcgggtcccttgggccgaaaatgccatgagggcggatggctgtggttaagaaattcttctcaggatcgttggcgcccagaactgcctggaggagagtgggagaaggggcacgtccattgcaaattcctaggcccaagccaagagagtgcctcgctgggtgagaagcaccactcgtgggggacagacagatgacacactctgctggcatgtggccactgagcagtggtctgccttgagctgacaacctacatcagtggctggtataattctgggctacctctctaccccacccaccctcacaccaaaatctgaaaatgcaggacagacagctgggcaaaaactggtaagatcaaatcagaaggccctggtttgcgttcaaaggctaaaatccaccaacactgccagaagacatgcctcggcagcagtttgtggaaaacgtccaaaggttctggcaaacaagttagccgtgagcctccagtgacttgaactgcatgtgccgcccacgtttccaccaggccgggtctgttccaggcaattctgagtatcacctccgaggggagggctctgagaaacccaagtgggcccagaagagggtcagagaaggtgaagggtctgaagaccatgcctggggagaaacaggccagcagctggggggcaaaggaggccgagacatgtaaagtcctcagagcagtgcctggtccagagccagtgctcctgttgccaccgcaaggaaagggtgacttctgtgtgacttcatggacaaactagaactcaagagtctaaagcacagtgaaatgggtttcgcctcaaaagtaacaaaactttccaaaggatttgttttatcgtgggtaaaagtggtgatcataaaggtacctaccctgacggggctgcatgcgaattacatgagatggcccatgtgagttgcttcagtgcgtgtctgtatgcttggtaagtacggttcctgctgtcatgtcacctcgggtttcttctactctatggtagcaaagtgctggtctatgttttggccccagtgatcttaagcaactcaacaatggaaaagctgcctctcaacagattcccagagctggccctcctcttcccgccaggactctggtccccacagcgatggaggaaatgactaaataaaccctcaaatggcttccaccaaggctcatctctactactaaagggaagagaggtgaaggagtcctagctccccatcacatttggtttatgatcagtaggaaggttataaagccaacagtggatgtcaacctcggctgaaaggaggcttccggtgagttactgctggagtcatctgcaggctttgcttatttccagttgagaacccaaaagttgatataagcgagacactgatggtctgggccaaggccatcatttgaagctcctgagcctagatgggctcagctctggtggcaatcagtatcaggcatattgggttgagaatacacagggtctccatggtgactgaactgcctgcaaggcgcagggaggctttagtactccttgggccaagttcgagcacatgagtgctccaaggagcaagacagcatagtctggagccaggactgtggcttgccaaagttcaagcctccacccctggtctgggtggcccttgtgtctccctgtggaccagttctgccaggactttctgagctgaagcaacagcagacaggctgggcatggtggctcacgcctgtaatcccagcactttgagaggccaaggcgggcagatcatgaggtcaggagttcgagaccatccgaccaacacggtgaaaccccgtctctactaaaaatacaaaaattagccgggcatggtggcacgcgcctgtaatcccagctactcaggaggctgaggcaggagaatcgcttgaacctgggaggtggaggttgcagtgagccgagatcgtgccactgcactccagcctgggcaacagagtgagaatccatctcaaaaaagaaaaaaaaaaaaaatacggcaaacagccaggaggcagctggctctcaggtagccaggtcagtgttcagctccagtacagcatgtaccggctttgcgagaaaacctcagtgggtgtgatacactgcacacacctgggaggggtatactcacagctacccagctaagacgagctatcccaggctcaggagcactcctggcctgcagcttaggatggcctcagggtgacaatccccatctgcagctagcagttgtcaggggccccacagccccagcagcctgaaggcttggtagcgaccgtggctgaatccaaccatactaaaatcaggtgccctttgatgaagctgttttgccaagtggaaaagtactttttccttaaaataaagcaagatccttccgttgtttgtttttctaagtaagggagggggtgagagtgccactaggaaggtgcctccagcctgattcctgtctgcacgcttgcaactgctgtaaattcccatagcaggcgaggaagctcccatggcattgagggtgggctgtaagctctgtagacagactgcctggggtcagccacctcctagctgcacagttttagaaaggttctgagcctctctgtgcatctgtgcaccacagtcttcatctataatctggtgatgatgcgataattgtgacctttaaacaaggaaaatactcctggaaaacactcagaacagtgtctggccacataaagctgttctcatagtaacttttttttttttgggagacagcgtctctctctctctatcccccaggctggagtgcaatggcacaatctcggctcactgcaacctccgcctcccaggttcaagcaattctcatacctcagcctcccaagtggctaggattacaggcgcctgccaccatgctgggctaatttttgtatttttagtagagatggggtttcgccatgttggccaggctggtctcgaactcctgacctcaggtgatccacccacctcggcctcccaaagtgctgggattataagcgtgagccaccgtgcccggcctctcacagtatttttaaatttaatttcacccacaaattttacatctcaaatcaggtacgtaggcctcagaatacaaacttcataagttcataaacatttttcttaggattctaaacccttcagtctgctcactcaaccagttccaaggtacataccctctcctgtaagatcttagtctctgtgtagtagtcaatgggtttcatggcatagggaaggtcttcagttccattcttgatatcgacgccctcaaagatgacactggcactgctggttaaaatgagtttctgacagaggaaggtcagaaaaaataaaagtcacaaattatcacaattcaaacagtgcatgatcctgtatgaaagagaatcaggggcatccctttgttgccctcgcattcgaggcactgaagaaattatttgctgcaatgcctttgcttttcatgccttcttaaaataatccaaagatcaccatcttttgcagctatgtggattccagacacactatgtattacattctaaccaagaatcaagagatcttggtttcaaaacaagggataacacattttttctatcccatcacacctgagagatagaatagacttgcattcatggtatctcactatgacagcgattctctgttgtaagtgaagggcagcccgcaaacttctaggaagatgtctgaaaaagatcactggctattctgatagtgacctggccatgtgaacacacataggaatacacacaccacacgacctcttaagaaatgctattctaaaggaagatattctcttatgagggtccccagcgtccagcctgctggttaagagaagctcatccaacactgaacaccattagcatgaatcatatcgttcccattcttattcaacattgtatgagaagctctagccagagtggtagggtaagataaacacgaatttataatgatttgaaaagaaactgaacttccatcgcttacagatgagagaaaaatctacacagaaaacacaggcaaatatgtagaaaatattagcgtttggcaaagttgctgaattaaaaatcaatatacaaaaattaactcgtcttatatattagcaataactgaaaatgtaatagaaagttattaaataacaaaaaacgaagtacatacaaataaatttaacgagatatgcaaaatctttacgaagtaaagtataaaactctattgatgacattaaagagcgagataaacagaaacatatcccatatttatggacaggaacactcaatatgggaaagatgtcaattctctccaaaattacctacaagttcaacacaattacaacagcagtctcagctggctttagcaaggaactggttaagccaaacatatgtagaagaacaaagggctcagaatagccaagtgaagtttgaagaaattggttgggggcgtgatttatctacggtacactgagacttatcctaaaaaggcagagcttctctgcatgggcagacagggaggtcaatggggcagaggggagagcctgggaacaggcccatgtaagacacaaacacctaagacatgctgcagatggtgtgcagcgatgcagaaaggatggattatgcaataaatggcactgaactggttatacacatggaagaaagttagatctctatctcacaccataagcaaacataaattcctggtggattaaagactgaaatgtggaaagcaacacttaaaacctttgaggaaaaaaagtacattaaataatcttttgatctcagtgttggaaaatgttccttcaatacaacacagcaatcactttctgcactcttacccactaagccactctgccccttcagtaaataaaccagagttacatatgccaagatgaataaagaaaaacataacactggggaaaaaagcaagttgcaggaggatctgttcaataagatatcattgtataaaatcttataacatgcaatccaatactttatattgcttacacatggagcaaatggaaataaacccaaattcagaattgctatccatggctacaagaagagagcaatggcatcgaggatgggcacacattacacatgccagtaatgttgtttcttaaatgctgtggtgagtggagaggtgctgttttattctcaaatcttgttgtttttttaattttttttttaagagacaaggtcttgctctgttgcctaggctggggtgtagtgttgggatcacagctcactgcagcctgaaaatcctgggctcaagcgatcctcctgcctcagcgtcccgaaacagttgaggctacaggtgcataccaccacacctggcttttaaaaattcgtgtagaggtggggtattgctatgttgctcaggctggtcttgaactccttggctcaagggatcttcctgccttggcctcccaaagcgctgggattacatgtgtgagccgccacacctggggcacaaatctttgttgtatgcccccaaccttccatttaacaaagagcagcagggcccttcccagggctccagttacatcagcatggctgagtgcagagtctgggacttggagaatctgctttgaccccacctctcccatttactagcaaagagacatcgtttagcccctggtcacccaacgaggagctaattaggtgaaaacttcagcagggcaaagcatcttgtcaactgctaggggtcagttataagtgatcttttccagggcccaagcccagaagagctccaaccctgctgggccggctgaggatgctgcggaccagccaacagtgccaggacaggttgttgggagaggaaccccctggcttgcttcaagtttttctcttaatttatgcagtacctgtggcatgcatccctgtgagggtcaggatactgagctgacagggagccgttttagccagtggctggagtcctctaaagacaattctaagaaccaggattggtaacgatgcagcaagctatgatgggcagaaaattcgtatcccctcaggcctgagttataacacgtttctattggctaagggtaaacacagtttgcttttcttttaaaatataagcaaggtctggaaaacaatgtggtggctcctcaaaaggttaaacgtagaactagtatatgatctagcaaccctacttctgggtagatgcctgaaagaattgaaaacagggacttgaacagatatttgtacacttgtgttcataacactattgtttacaattgccaaaaggtgaagacaacacagatgtccatccatggctgaatgaataaacaaaatgtggcccatccatacaatgaaatattgttctgcctgaaaaaggaaggacattccgacacatgctacaacatggatgacccctgaggacatcatgctcggtgaaaagccagacacaaaaggagaaatactacatgagtccacttctgtgaggtccctatagttgtcaaacccatagagacagaaagtagaagggtagttgccaggggctgggtagggaagggcgattgaggagttgctgtttaatgggtatagagtttttattagggaagaagaaaaaggtttagagatggatggtggtaatggctatacaacattgtgagtgtacttaatgccactgaactccgcacttaaaaatggttaggatggtaaattgtatgtgatatatattttatcacaataaaaatataagcaatgtctaagttctgcagctctttaactgaaggccaataggcttgaggtcctcagatgttctatttgtgtgcagttagaatattacatctcaaatcagccttggcaagcagaccttcaccatctccagtgactccaagggcttcatttctaagatcttcccaacactttaagaagcaaccccgcctaggcccagggagactgcaagaactacggccttgcacccttagaaagggccatcacgtgctcctgacagcactcactccagccttccccttacctgaaccccagcctctttgcaagtttcaatgacattcttggtgccaatgtaattcactctataaaagagctccttgttgttactggatggtgggggtgacgcacagtggaaaactgtgtttacacctttcagagctgggtacagatcctggaaaagcaaagaaagacaaaataatcattcctgctttgacaggtcaatggcattctcatgttttcaccctccaacctgtggcttgtaggttccttgtcttataattctataatcaatatggaaatacattctcataaaagaatcaatgataccgaagtacatgggatggaaaccaagttgtccctttaatcaccttctccccactaactagtccccagtcaaaaggggtttggggcatgagaagcctgtgggatccacacagaggcaacatccttttgggtggttcagagcaggcacctaggaggtaaaactccccaggaaggtgaactcagatagaaattatgaatcacatgaaaaagttccacaccattaaagacagtaaatagccaatacacaggcatattccttcctgtgaaacttgacacaatacagcaacctgaaagggatttttaaaacaggtctgtttgatttactgctaaaaggaacaagagctcctgagagaaatggctgattgcagatctgggacaggaaacacacaagaggaaccaggcacaccttgtaccagagagtgaggatgctagctagctaagactaccggggtcacgttaaaagcactcaagggccaacctgaagaggttcccactgggcaaagaagggacagcttgaccacaagcaagaataaaaattcaggtaaataaagggaaagaatcaaatatttattctgcattaaggtataaagactggagctactaaatgaagactaatagcatgtcatcattttgtcaaaccttaattaagtaatatgatctaagtatgattcatgtttgtcaccaaaagacaattatgacaattatgtgccaattaatattttgccacaatttcctctctctacatacaatcacatgattttttttttgaaaccagtcaagtaagttgcagacatcatgctgcctctaaacgcttcacaggtatctcctaagaacaaaagcattctcctaaataaccataaaacaatgatcacactcaagaaacttaacagatatgatgttcttatccaataattagtctatattcaaattcccccaattgtcccagtaatgtcttttatagccttttgttttggggtccaggatccaattgcgcatgacatgtagtatttagtcctcaggtctcttccatctcttttaatctgagacaaattcccgtcttttctgtcttattttaatgctgccatttttcaagggtttgggttattttatagactgtccttcagtttggattagtctgtttcctcaagattagattcaggcttaatggttttggcaagaataccacatcagtggtggtgtgtccttctcagggaattacctcaggaggtgcaagtctgtcccacttttggtgatattaagttggagcacgtggtgatgatgatggctgccagattccggccatcaaaaaggtaccttttcctttgcaattgataagtaatctgtagcatgttaattctaccaattaacctcagcatttattgatagtccttgcctggaacaataatcaatgtactgggtataaaatggtgacattctaagtctagccttttaattcatggcctttacatttattagttggcattcctctgtagagcttccccttctccctgaccccaattgttattttcagtatttctatggacccatggattcttttttattttatttttttgagacattgtctcgctctgtcggcaaggctggagtgcagtggcatgatctcagctcactgcaacctctgcctcccgggctcaagcgattctcccgagtagctgggattacaggcgtatgccaccatgcccggctaatttttttgtattttagtagagatggggtttcaccatgttggcaaggctggtctcgaacttctgacctcaggtgatccacctgtcttggcctcccaaagtgctggcattgcaggcgctagccctgcacccagcccacggattctttttgaaatcaaaatgcattgtcatccactactgttatgttttgagaggctcaaaatgctcaaaatgtcccaaatttggccaggggaagcccttcaagttggctcttgtatcttcttggcaggtccccattcattttgtgctaagaaaatgtcccagactcattttgtactgcccttgccctagggtcctagaatgagcaattttcccaagaagccctagttctttttatgggaaatggtatatagaaacccaaatctgagcactaggcatgcttattactattggagtatcagaagtaataataccccagagggaaaaactgaaccagagtccgatcaagtctttagtccagtagaaacataataaaagtcacagtgactttaaagtttatagtaatgacattaaaaagtaaaaagaaaaaggtgaaattaactttaatgagacagttacattccttttttctgtaggtagtttttgaaatctggtgtggacttcacacttacagtgcttctcaattctgacttgccacattttaagtgcccaatagttgcacgtggctaatggctgccttaatggacagcgccatcccagatctaccagtatacagaaaatactggaggacagaagggcatgttaaacgcaatggggatgtaatcggcaaaacccagactgtgggaaatactacagcaccataaacatggtttctactaaacatcagttattcaataaatagactgaagtttaaaaaaatgaagggaatcgtaaattaaaagagagctaaatatttcaaccaaatccatagtcttgatcttgcttggttccttatttggaaaaacaataatacaaaaacatttataagacattcagggatatctgaacgctggctagatactaaggaactactgtcaatgtttttaaaaataatccttatcttttagagacaaatactgaaatatttgcagataaaatgatatgatgtctaggattgacttcaacataatctgaggaggaatataggtgaaacacgattggccatgagcagaggcagggaggaggaaatctcctatgaaatagtacaaaaagagaaagagaaggaatgcaagaaagagaggataagagacagatgatacaatgaaagaccaccatatgtccagcacggcttctagaaagagagaaaagagagaaaaggggtagagttaatctttgaagaattttccagaaatgaggaaagacattcatcttcagattgcacaggcctaccaggtgttaagatttaaaatcaaaactaaaactcaggcccagatatattctctatagactataaatgataaaaaataaaatcctaaaaaccataagagggaaagccagacaacctacaaacgaacaacgaccggcttgagagtagacttcctgtcagcaacaaaagatgcacaagaccgaggtgactttaaaagtgtcatgggccgggcgcggtggcaacggtggctcatgcctgtaatccgagcactttgggaggccgaggcgggtggatcacttgaggtcaggagttcaagactagcctggccaacatggtgaaaccctgtctctactaagaatataaaaattagtcatgggtggtggtgggcgcctgtaatcccagctactcgggaggctgaggcaggagaattgcttgaacccaggaggtagagtttgcagtgagtcaagatcacgccactgcactacagcctgggcgacagcgcaagactccgtctcaaaaaaaaaaaaaaaagtgttatgtaatacatattgtgtgtataaaactatataactatatatacataaactttatctatatgtatgtatatctgtctctctcctctctctctctctctctctactgactataaaaacacatttttaaaaaaaaagaaatggggggggtcttgttatgtagtccaggttagtcttgaactcctggcctcaagtgatcctcccaccttggccttccaaatagctgggggactacaagtgcataccaccacacccaggtgaaagtacattttaaaagtccttctcggctgggcgcagtggctcacacctgtaatcccagcactttgggaggcagaggcgggcggatcacctgatacaaggagttcaagaccagcctggccaacatggtgaaaccctatctctactaaaaatacaaaaattagccgggtgtggcggtgggcacctataatcccagctattagggaggctgaggcaggagcatcgcttgaacctgggaggcggaggctgcagtgagcttagattgtgccacagtctgggcaacagagcaagactatgtctaaaaaaataaaaataaaaataaaataaaataaaataaaataaaaaaggtcctctcctgccatgtctttcacccacatcacatcgaccttggacttagcttagatttcatgatccaccagcaccacctttgccttgttcccctctccctttattaaatttgtctagtaaactccaaccctggttaaatgcaactcgccccttctccacgcttgcggctgagcagttgagtgtggctggagaacaacatggcatgctggagggttcccttgaaatctgtactcaaggaaagctgaaataacatactagcaacaacagcatggcagcgggggagccttttggagagaagtgaaagcttgctaaggattctcgtctcctttgaggggacaaagcagtgatcgaaaaacaaaattcctgcttttgtggagtttacattctatggtagagaggacaaatttcagagatttcctctgctctgtatccgctcatggtcaatcatgtttcaatcaggacaaataagcaaacaaacaagtaaatctagaggacgtccgtactggcaggtgttatgcagaaactagagcagagtaagggagaccagcgggggcctgttccttagcacagggtggctggagatttacaggaagctagggagcaagttctgtggttcaggaagagcattcctgacagaaaggacaccaagtgcaaaggtcctgaggcagaaacttggttggtggccagtgtgcctggggcagagccatgaggcgggtgtgggaggaagtgggccagacaggtagtggggacgtgccgtgcagggcctcatgggtgattacagaggcctctgtttgcttgacatgggactggacgccactggaggcttctgtacagagggcggtgtgatctgatttatccattaagagtccctctaacatctaggtgagacagtgatggtggcttggaccagggtggcagcaatggaaggggtgagaagttgttggattggggatctattctgagtggagccaacaagatttcctgatggatgggatgaagggcatgagagagaaaggaatcgggcagggatgaatctaaggtttttggttgatggaactggaaaagcagagtaggccatttatggagatagagaagacttagcagaaataggtttgctgtggtgggggaggggcttgcgtcagggaaccaggagcttaattttggatgtagcaagcttgaagtgtccatgaggtatccaaacagggatgtccagcaggcatacacacacatacgctcacacacacacacacacacacacacgtgcctgagagagctaggggttggagataacaagcagggagcacatcagcttctagacagtaattaatccatgagatgggatggagtcactgtgacactgtctaaacttggagaagaaaagagaataagttctggagtctgcaaagtttagaaatgatagtgatcaggagacaatcagtgaggcaggaggagaaatgagtgaggtggtatctcagaaggcaagcaaagaaagcatcagatgctgctacagggccaagtcagaggaggactgagattcaaccaccagatatggttgcctcaaggtccctggtggcagtgactgggtagggaagaggaggtggcttccagctggcaccaggatgggcactttggtggggatgaggcgtcctcgggaacagcaggggaggctgagtagagacgtggatgtgggcaggtttgtggagatggtgcttggtggtaccaagggtctgcttgagggccatggccatgcacaaggcaagatttaaccagggtgggggttacaatgtgaagtacactgtggtggccacatttatttgccacctgggccaggctctagtccccggtgactccattaaacagtgtaggtgttgctgtagaggtattttgtagctgtggttgacatctacaaccagctgactttaagtaaggagattacccttgctactctggacaggcagtatatactcagttcaaagaccttaaaagtgaaactgaggtttctgtaagaagaaattctaacgtgggaccacagcatcaattcctgcctgagtttctggtctgccctacaaatttcagacttgcctagtcagcccccacaatcatgtaaaccaattctgtgaattaaatctcaacctctctttctccgtctcacccacccatctctctccttgcccttctccacacatccccctgctggtgtttctctggagaaactttatggatacatacaaccagaagagaaaggggaaggggtgaagactatgcaagcgaacaagcagaccagggaactaaaggcagtgaggcacgaacaggctgagccatggtgggcatggctggatgtctgggtggggttaaggaatcgggacagctgaggcactagagggcatgagctggacagagaggagctagtgctcagagtagaatgcctgcaactgagaagaaggagaggacgtgcttactggtgatgacaggggagtggagggcaacatcattgggtgagaggaggccaaggatgagagaggcgagggcattggtagggtcatctacatgaacgctgaattcaccaataataatgccagaaaggagctgaaatcactgagaaatgatgtggagtcactgggaaggggagcaggcggctgtgggtggccaccacaaggagggaacggtgtcggggtttgtacagtctgagggtatcctcttcaaagctggagaggcttagagcagcatgagggagaacggttcggaggcagcaatgatgagcatgaaagatgtctaccccatctccaggcctggaggtgtgggcagcacgggagagaaaacaaccgtaactttgcagcggaagcaatggccttaatatttcatcaacaaaccatatagcgaatgacaccaaagccaagaataagggcccagtgacaggctgagggaagccatccataataagtacaacgggcacaggattggcatcccaactagatcaacaaggaagcaaaggtaaccccaaagacaaaggggcaaaggacacagacaaacatttcacacaggaggaagcctgaaagccgatcacccagtggcagagtggctggttacttggtcagggaggacatgtgactctgaacatcagtgaagcaccacttcatacttctcagaatggcaacaccaaaaagtctagttatgcccagtgttggcaaagatgtgaagcaatggggcttgtgccacattgtggatatggaggtaaaattgacatagcagctttgctgagccatttggcaccatctaataaaattcaagatattcatacctgtacaacatggatgaagcttgaaaacatcatgctaagtgaaaaaagtcaggcacagaggtacaaatattacatgattccatttatatgaaatgtccagaagaggccaatccatagatgggaagtagatgagtggcggccaggggctgggaggggaagagaggggatggctacaagatttcattttggggtaatacaaatattctggagttagatcatgggagacagttgcacagctttgtggatgtactgaaaatcactgaattgcacactttaaaaatgtgaaatttgtggtacatgaattatatctcaattaaaaaatcaagaccctgtggcccagcacacacttgttttgcagttggaacaatacagcccatggacggcttttgaagtcaagtttcactggcatacagccacagccatttgttcatttaagtgctgaccatggctgcttttgtgctaccaggacacagctgagtatctgtgacagagatgatggttattcattctaagcagtaagaatgtggtgttctttcctataactttgaaaattttcacaatgaaacaattgtttttcaaacaaattggctggcttctgagcaagggaagtatcgtggtttcccttcgtgggctcgtgggaaatcagcaaggctgcatggtccattacctgtcggctgcagaggtcacccagaaagaaccgcacctggggattatcaaacccttgctggatatcaaatacattgacagcatatcctcttgccagcaactgctccaccatgtgctgccccaggaatccagagccaccgatcactgtgcatctcttggcctgtggaaagagaggaacggtggggaagaccagggtagtgaggactggaagctacagagtccagacttacatatcatgagccactgcaatggcagatatacttgtttgtttggaactcttcttgagccaagttggaagctttatatcatcctggtgttccatcactagtgcaaccctaaccttctctcctgggatcagtaaggagggaagagagatagcgaatgacactgagattgactttggttgggtttgatgacaagatccatgctttgtattcagtgaaaggaaatcaaaccacctatgaccaaaactggacaatctaaaaaataccccaaaaaacagtgataccttcttgttcccgatagctgatccctgggcgcttctctaaggacaaaacaaaacaaaacaaaacggcagccatttggtagctgatagcttgcactgaaaacaacagaaagaagaaagcagtctccatacttgcaggacaaagtcagtccctttccctctctggccacaacagggctgggctgtgtggctctgggctcatcgcccaaccccttcttgcctcagcctagaaatctaagaccgccttgatgggatctcctggtggggctgcagtgaggatggatgagcccagggctctgctttccctcctccgaactacaaggaagttgaagaaatggggagagccatggtgtttatgtctcagcctccacaacacacacgattccttgggtaattccaactctggtgactgggcataatgaaaggacacagtagcacatgcaggcacttaaataccctcatttcaggatgttgatgccaaactgtggctgctgcacaccagacaagctggctatgggtgtctgtgaggaggacctgtgatatccctcctccctagggtctttctaaaactgtatctgggcctccttaagatgacaacctccaatttccttagctcatatacagtaaatccaacttgggtttgtggaaatgaaagatcttaaagaaattatgttctagatttaaaaaacaaacaaatctccctacttattccttaaacatcaacacaattgagctatgcaagagactcaagggatgccagggccagacatcctctctagatccacctccctcccagttggggtgtcccatctgaaacagcactcatactggattccaccaggcccagctggagctggcactgtactttaccttcatctgtccatgtgcaatctactaacaaaatcagcctcaccattcttctaccacccaaaactaacttcccaacctgttcttttctaggctttattctgattattcctaaacacatgtaatcataccaggttacatgatttgcacctggactgagatgtatatttcctcaagtcatagccaaattaaatacaaaactcacatcaatcccttttctagcaatccctttcttctcccctcctcccaagtcagctgtacaggcaaactgtagctatttagaataactctgagctgcctgtttcccaacctggatttctgcagtttactaaaagtctggctaagcccaaagacagtcagaactagatatgttactaaagcatcctgaaagatttcagactgccttgtttatttcatttggcatctctagttacaggtgtttcaaaaggttgctaatctcttcaaaaaacaaccttgctgttagtccagtgtgatttcatttcacgattttaattgtgactaatcagtacgctactcttggacaatgtgacgtggattattttatgatattgaaatgttctatcaataatgtttgggatgagtaggccaatggctgttccctggagacccttgtagtgatgggaatcaaactggcctttaccccagggaagtcaaatgtgtgataatcatacctataatgctgtgtgattacaggagatcacatgaaacttttcatgaccactttttacttctcacagccacagtggacaagaatgaacatgtactaacaatcaagtataaaactcaagactggaaacagcaagactccataatgggttactgaggtgagttataagatcaacctcttggagacagtgttaagaataggggccaggcacggtggctcatgcctgtaatcccagcattttgggaggccaaggtgggtagatcacctgaggtcaggggttcgagaccagcctggccaacatggtgaaatcccgtctctactaaaaatacaaaaaattagccaggtgtggtggtaggcgcctgtagtcccagctactcaggaggctgaggagggagaattgcttgaatccgggaggcagaggttgcagtgacctgaaatcacgccactgcactccagcctgggcgacagagccagactccatctcaaaaaaaaaaaaagaaaaaaaaccatttaggcaaactaatctaattgcaatagaatcttgagataacagaatagtctagggcgctgggtttttccaacccttcttgttttgctttgttgtcagcagtgggacccttttctcagagaggtcttatgcagaacgtatagtaagttaagacaaatgtgttctttttgttttagtagtctaaatttagaacttttacttcttataaaatcagtccactaatgagagaaaaaaatgttatttcgaaggacacaaaaatttgaaactagctgaaaatggcagtttgctataaccattggaatccacctttgtttgctggctgccaagtagccataaaacccaaatttacataaatgaggaactgcagatggcacgtggcttcaaccacagaggcccagaggaggcttgactctgagttctacaccaaatacagggtgatttcacggcccatgataacctcttagggatcttgaacctattaacatttgatataaacacattttgtcttgatgtaattacgttgtttgttttgttttgttttgtttgtttgttttgagacagagtctcgctctgtcgcccaggctggagtgcaatggtgtgatctcagctcactgcaacctccacctcctgggttcaagtgattctcctgcctcagcctcctgagtagctgggattacaggtgtctgccaccatgcctggctaattttttgtattttcagtagagatggggtttcaccatgttggcctggctggtctcaaactcctgacttctggtgatccacctgtctcggcctcccaaagtgctgggatttcacaggtgtgagacaccgtgcccagccacatttttgaagtgcagcactgattaagaatcaatcaaagcaaacctttgcagactgatgtgaagaatctccaggaagcctgacaacgaccaggctcaacaatttcttcaagtcctctctcagactgagacttgcgacactaaatcttaggcctaataaatactgctgccatttcactaggaagcccagcctggtctactggaggccacatgaaggcaaaccaaggtgcccagttgacagccaccagttactaccagaggtgtgagcaaggccacctgggagcatatgcttcaaggggtccccatgtgattgcaactacatgcaagagcccaggggagaccatccaagaacaccccagctgggctcagccgaaaccacagtcataagcaaagaaatggttgttcttttaaaccactgtgttctgatattgttacacagcaataagtaactgacacatcttaaacaaagctatatatcttacataaaaaatacccaacattgattaatacatgtacaaatacaatttttcacccacaggtaaatagtatcagcctgttggtatgtacgtgtcaactttctccttacctgattctggttaaccttttctatgtcagcattcactttgggagtgtcctctgtcaaatgagtccgtgcgacttggtctctcattggctcgctaactgctggttccatttcgaagcaaaatatggtcccgtttgtaatcaacttttcttttcttaaagacatagttagagacagacattaatgttgcctaagtcaaaacatctttagttgttagtgttttgggcagatgccatccccccgttcatgtttttacaaatagctgaaccatagcgacagctgttcgacaagacactaggctcctgagtagctgggattacaggtgtctgccaccatgcccggctaacggggccaacgactgggcctatgactcaccacactgttagattagaggcgcacaggaggccagttaaatcagctcacttatcagtgacaacataaaaaacgtctttggcattgtagctttttccatggctctcccacgcttcagtcagcgtggatttcccctgtggtgctcattagggtgtagcagtgcccacacctagggagtcctgctctgggcctatcacgaactgtacggaattgctccagtcacttccctttgctgcagctcagttttcccatcaatgaaatgggcacaagggctcatgtctaggagctcaggacatgggatgctgggacgggggatgagtggagtgcaataggagacggagctctcctgcttggctaagttaaagccgccctgacgatgcgtggaggaacttagcatcttgggccatcagaaacccttgagaagtgatcagagtacagtgggcacccagcagttcacagcagggagacggtagcaataaaatccgacaacgttgccaaacagaggagtatggctttagtgacagcccttagggtgctcctctcctcagtcacccatgatactgaactgcaaacacaaagatgccacttgactatgatgtatttggtcttgcatccatgttttcttggtagttgccaatttacttagtcatggctcccctaacatctggagatggcaaaacccacgacaagacaagagtctaactttgctcatgaaaggctagattcacagaacacttcagtgaggaggtggcaggcagcactgggattccacctgctgtgattgctccaatccaaccccacacctcgaattttacactccttgccacttttaacgaatgggcatgatcatgtgtcccagtggggacagactttacgggcatgtagaaagccaaaatggccttgaaatggatgcaggaccctcaatgtctggaggagccatttgggggaacatttttctgaactcataatggaagttattaagaaactgtatgtcaaaacttgacttgtcatggccatttttagaatgcattgaagtcaatctgtagctctgtgcctgccctgtccctccctttatcccagaatccccttcacattggtaggggccctgtcaactgttcattcgaaagacatgtggctgatattgaactcactgggactcaatgtgtatctagaccaaagcagctagagaacaaggattttggcaccttgcaccaaagccttgcccactgttgcaacttgggcatgaagcatagtgcccagcacaaagtgggcactcacatatcggccgggggtcatgagactaccatgtgtgggcacacccaccagagctcccatactgctctccatcgcatacatgcatatcccatctaaggtgcaggggcttcagtggggcaagtgactgttatttagtgatgatataatcacgaatgcccactgctggcttcttatccagattccccagatattcagggaaatgtgagcaaatgaaaaggcacatggcatctacaggggcaaggagatggctcacatctggcctctgaccccaccaaggccttattgacctctgctggcaggggatctgaggggcgtgtgcctggggcagtgacaggaccgcatgacaggctaactaggccagccgggctaagcaagcccacccctgtggagttctgctcttgtaagcctctgctcaccctctacacatgagaaatcacaaatcacgccactcctcagtgcagctggcaataaattaacccagagtcggctgcctgggttcaaatcccagctactattccttaccagcaggtagccctcgggggagttatttaaaagaactgagcttgcctttcctcatatgtaaagtaaatggcctcataaggtcattatgaggattgtgtcaaatacctgtcaacacgccattcaaggcagctaattttattatcattgtaacacagcttcctgtgcaggagtctccctgcctatgcctcctcttgggctgcctttggactctctccaccactttagttctcccctatctaatctgctgccatgcggtataagcttgggcaggcaggggctgtcctatctgtcctggaaacggctcccaggtcctgcctaaaggctaactcctggggttgtcgcaacaactagatgctggctaacaaataaacaaccaaggacatgctttgtaaagtaggtgtacagcgacagcatggggcaggagtgtaaagaaagactgggactcgcaagcaaacttgggtggaaagaatcatttcctctttggcctcattcaatgaatagcataatgactaacaccaaatgcttcattcagttcttcttgaaccaaaaagtaactttaactgctcccgtagccttaagttttgcatgaaaagtaggaaaagaatgggccaatagaggtccttggaggcctggtaggccctaaatccaatgacaagtggtcttataagagacatacagaggggaaaggcagggagaagaggaggaggccatgtgaagatggaggcagaggttagagtgatgtggctacaagcaaaggaacacctggagccactagaaggtggaaacaatgaagaacgagtctcccctggatccttcagagggaacacaaccttgtcaacaccttgattttggacttgtggcctccagaactgtgagagacacatttctgcttttctaagtcacccagtttgtggtcatctgttacagcagacccagcaaactatacgagtatcctttgtagtgccgaaatccaaatagcagagctgccaattccacaagtccccttgtatgactagcaaaagcaagaagccttagagcctattcctctcctcgtttgctagaggaggatgtaggaggtcaaagaagaaacatgtctcaccccaacggagctgtactgctgaaacaataatcacacaattctttgcaaaccagcctcttgtcaaaacaaaatctcctttgtctcaaattatataccaattattttaaagtttgtaaatactatgagtcagataagaattttggtgacagcttagctgtctctatgggttggagtacccagagctagccgcgcaaatgagtcagatcccataggcaacccccgtcccctgcctactcacctaaattcaccatgtgatatacgcttgggttaaaatgtacattgagaatagctctgactgaatagacatttctccaaagaagatctactttaaagatggctaaaaagcacatgaaaagatgttcaacaggctgggcgtggtggatcacgcatgtaatctcagtactttgggaggccgaggcaggtgaaacacttgaagtcaggagttcaagaccagactggccaacatggtgaaaccccgtctctactaaaaatacaaaaattagctgggcgtggtggcacatgcgtgtaatcccaactactcgggaggctgaggcaggagaatcacttgaacccgggaggcagaggttgcagtgagccaagatggtgccgccattgcactccagcctgggcgacagaacaagactctgtctcaaaaaaacaaaaaacaaaaaataaaaaacgatgctcaacgtcactaatcaacagggcaatgcaaatcaaaaccacagtgaggtgtcaccttacacccattattaggatggctattatcaaaagccagaaaagagaaaatagcaagtgtcagtgaggatgtggagaacctggaaccctcatatattgttcatgggcatgtaaaatggtgcgacgttgtggaaaatagtatggcagctcctcaaaaaaattaaacagagaattacaataggatccagcaatttcatgtctgggcatatacccccaaaaactaaaagcagggacttgaagaaaaatttgtacatccatgttcacagcagcattaatcactacagccaaaaggtaggagcagcaatgtgtccactgacagatgaacagataaacaaaatatggtctagccacacacgggcatattcttcagccataaaaaggaatgaagttctgagacatgcaacaacatgcgtgaacctcgagaacattatggtcagtgaaataagctagacacaaaaggacaaatgctctgtgagtggggagtgactgctgatgggaacagactctcagtgctgcaggaggaaaagagttctgaaggcggatggggtgatggtcactcaacaatgggaatgcatgtaatgccactcaactgtccacctaaatatggtgaagatggtacattttctgttatgtctactttaccacacagacatacagaagaatagctctgaactactgaaaacaagactccaaagagcaatgttttaggggctggtggattgttatggttcacacatcagaagcctcaagtctcttcctttaaaatgttagttatttgaatccattaaaaaccaatatgtgcacccacgatgtacactgggacaaaatcttaagctaaaaataatataggaaaacagagatatgttgtactggtgaaatccaaccaccttgccccacaccacaggcccatggaaggacaaagttgagctgagctgccacagcaaaataaggctaaactgaaacctctaaagagatgtgaactcagttcattccaagagggccgaataggaacagctccggtctgcagctcccagcgtgatcgacacagaagatgggtgatttctgcatttccaatggaggtacctggttcacctcgttgggactggttggacagtgggtgcagcccatggagggtgagccaaagcagggcacggcgttgccttacccaggaagtgcaaggggttgggggatttccctttcctagccaagggaagccgtgacagactgtacctggaaaaacgggacactcccgctcaaatactacacttttcccacggtcttagcaactggcagaccaggagattctctcctgtgcctggctcggagggtcccatggccatggagccttgctcactgctagtgcagcagtctgagatccacctgtgaggctgcagcctggagggggaggggcgtccgccattgctgaggcttgaataggtaaacaaagtggctgagaagctcgaactgggcagagcccaccacagctcagcaaggcctactgcctctatagactccacctctgtgggcatggcatagctgaacaaaaggcagcagaaactttggcagacttaaacgtccttgtctgacagctcttaagagagcagtagttctcccagcatggcgtttgagctctgagaaaggacagactgctcctcaagtgggtccctgaccctcatgtagcctaactggagacacctcccagtaggggccgacagacaccttatacaggcgggtgaccctctggcacgaagctcccagaggaaggatcaggcagcaatatttgctgttctgcagcctccattggtgatacccagggaaacagggtttggagtggagctccagcaaattccaacagacctgcagctgagtgacctgactgttagaaggaaaactaacaaacagaaaggaatagcatcaacatcaacagaaaggacatcacaccaaaaccccatctgtaggttaccaacatcaaagaccaaaggtagataaaaccacaaagatggggagaaaccagagcagaaagcctgaaaattctaaaaaccagcgtgcctcttctcctccaaaggatcacagctcctcgccagcaacagaacaaagctggatggagaatgactttgacaagttgacagaagtaggcttcagaaggttggtaataaaaaacttctctgagctaaaggaacatgttctaacccatcgcaaggaagctaaaaaccttgaaaaaaggttagatgaatgactaactagaataaacagtgtagagaagaccttaaatgccctgacggagctgaaaaaccatggcacgagaacttcatgacatacgcacaagcttcaatagccaaatcaatcaattggaagaaaggatatcagtgattgaagatcaaattaatgaaataaagtgagaagacaaggttagagaaaaaaagagtaaaaagaaatgaacaaagcctccaaataacatgggactatgtgaaaagaccaaatctacatttgactggagtacctgaaagtgacagggagaatggaaccaagttggaaaacactctgcaggatattatccaggagaacttccccaacctagcaaggcaggccaacattcaaatttaggaaatacagagaatgccacaaagatactcctcgagaagagcaactccaagacacataattgtcagattcaccaaagttgaaatgaaggaaaaaatgtaaagggcagccagagagaaaggtcgggttaccgacaaagggaagcccatcagactaacagcagatccctcggcagaaaccctacaagccagaagagagtgggagccaatattcaacattcttaaagaaaagaattttcaacctagaatttcatatccagccaaactaagcttcataagtgaaggagaaataaaatcctttacagacaaacaaatgctgggagattttgtcaccaccaggcctgccttataagagctcctgaaggaagcactaaacatggaaaggaacaactggtaccagccactgcaaaaacatgacaaattgtaaagactgtcaatgctaggaagaaactgcatcaattaacgggcaaaataaccacctaacatcataatgacaggatcaaattcacacataacaatattaaccttaaatgtaaatgggctaaatgccccaattaaaagacacagactgacaaattggataaagagtcaagacccatcagtgtgctgtattcaggagacccatctcacgtgcagtgacgtacataggctcaaaataaagggatgaagagagatctaccaagcaaatggaaagcaaaaaaaagcagaagttgcaatcctagtctttgataaaacagactttaaaccaacaaagatcaaaagagacaaagaaggccattacataatggtaaagggatccattcaacaagaagagctaactatcctaaatatatatgcacctaatacaggagcacccagattcataaagcaagtccttagagacctacaaagagacttagactcccactcaataataatgggagactttcacaccccactgtcaacattagacagatcaacaagacagaaggttaacaaggatatccaggaattgaactcagctctgcaccaagcagacctaatagacatctacagaactctccaccccaaatcaacagaatatacattcttctcagcaccacatcacacttattccaaaattgaccacatagttggaagtaaagcactcctcagcaaatgtaaaagaacagaaagcacaacaaaccgtctctcagacacagggcaatcaaattagaactcaggattaagaaactcactaaaaactgcacaactacatgaaaactgaaaaacctgctcctgaatgactactgggtaaatatcgaaatgaaggcagaaataaagatgttctttgaaaccaatgagaacaaagacacaacataccagaatctctggaacacatttaaagcagtgcgtagagggaaatttatagcactaaatgcccacaagagaaagcaggaaagatctaaaattgacaccctaacatcacaattaaaagaactagagaaacaagagcaaacacattcacaagctagcagaaggtaagaaataactaagatcagagcagaactgaaggagatagagacacaaaaaacccttcaaaaaaaatcagtgaatccaggagctggttttttgaaaagatcaataaaattgatagaccgctagcaagactaataaagaagaaaagagagaagaatcaaatagacacaataaaaaatgatataggagatatcaccaccgatcccacagaaatacaaactaccatcagagaatactataaacacttctatgcaaataaactagaaaatctagaagaaatggataaattcctggacacacacatcctcccaagactaaaccaggaagaagttgaatccctgaacagaccaataacaggctctgaaattgaggcaataattaatagcctaccaaccaaaaaaaggccaggaccggacggattcacagccgaattctaccagaggtacaaagaggagctggtactattccttctgaaactattccactcaatagaaaaagagggaatcctccctaactcattttatgaggccagcatcatcctgataccaaagcctggcagagacacaacaaaaaaagagaattttagaccaatatccctgatgaacatcgatgcaaaaatcctcaataaaatactggcaaactgaatccagtagcatgtcaaaaagcttatccaccacgatcaagtgggcttcatcctagggatgcaaggctggttcaacatacataaatcaataaatgtaatccagcatataaacagaaccaaagacaaaaaccacatgattatctcaatagatgcagaaaaggcctttgacaaaattcaacagcctttcatgctaaaatctctcaataaattaggtattgatgggacatatctcaaaataataagagctacttatgacaaacccacagccaatatcatactgaatgggtaaaaactggaagcattccctttgaaaactggcacaagagaggggtcccctctctcaccactcctattcaacatagtgttggaagttctggccagggcaatcaggcaagagaaagaaataaagggtattcaattaggaaaagaggaagtcaaattgtccctgtttgcagatgacatgattatatatttagaaaaccctatcgtttcagcccaaaatctccttaagcaacttcagcaaagtctcaggataccaaatcaatgtgcaaaaatcacaagcattcctaaacaccaatagcagacaaacagagagccaaatcatgagtgaactcccattcacaattgcttcaaagataataaaatacctaggaatccaacttacaagggacgtgaaggacctcttcaaggagaactacgaaccattgctcaacgaaataaaagaggacacaaacaaatggaagaacattccatgctcatgaataggaaaaatcaatattgtgaaactggccatactgtccaaggtaatttatagattcaatgccatcaccatcaagctaccaatgactttcttcacagaattggaaaaaactactttaaagttcatatggaaccaaaaaagagcccacatagc
